(12) United States Patent
Ganesan et al.

(10) Patent No.: US 12,076,413 B2
(45) Date of Patent: Sep. 3, 2024

(54) COMPOSITIONS AND METHODS FOR MODULATING DELTA GAMMA CHAIN MEDIATED IMMUNITY

(71) Applicant: JANSSEN BIOTECH, INC., Horsham, PA (US)

(72) Inventors: Rajkumar Ganesan, Blue Bell, PA (US); Iqbal S. Grewal, Newtown, PA (US); Sanjaya Singh, Blue Bell, PA (US); Michael Riis Hansen, Broomall, PA (US)

(73) Assignee: JANSSEN BIOTECH, INC., Horsham, PA (US)

( * ) Notice: Subject to any disclaimer, the term of this patent is extended or adjusted under 35 U.S.C. 154(b) by 0 days.

(21) Appl. No.: 17/512,195

(22) Filed: Oct. 27, 2021

(65) Prior Publication Data

US 2022/0125947 A1 Apr. 28, 2022

Related U.S. Application Data

(60) Provisional application No. 63/106,703, filed on Oct. 28, 2020.

(51) Int. Cl.
| | | |
|---|---|---|
| *C07K 16/28* | (2006.01) | |
| *A61K 47/68* | (2017.01) | |
| *A61K 39/00* | (2006.01) | |

(52) U.S. Cl.
CPC ...... *A61K 47/6897* (2017.08); *C07K 16/2809* (2013.01); *A61K 39/00* (2013.01); *C07K 2317/24* (2013.01); *C07K 2317/31* (2013.01); *C07K 2317/35* (2013.01); *C07K 2317/56* (2013.01); *C07K 2317/565* (2013.01); *C07K 2317/73* (2013.01)

(58) Field of Classification Search
None
See application file for complete search history.

(56) References Cited

U.S. PATENT DOCUMENTS

| | | |
|---|---|---|
| 6,737,056 B1 | 5/2004 | Presta |
| 8,242,247 B2 | 8/2012 | Klein et al. |
| 9,803,029 B2 | 10/2017 | Ellwanger et al. |
| 10,501,540 B2 | 12/2019 | Van Der Vliet et al. |
| 2003/0109416 A1 | 6/2003 | Nagata et al. |
| 2004/0018198 A1 | 1/2004 | Gudas et al. |
| 2007/0287170 A1 | 12/2007 | Davis et al. |
| 2009/0169547 A1 | 7/2009 | Sahin et al. |
| 2009/0182127 A1 | 7/2009 | Kjaergaard et al. |
| 2010/0015133 A1 | 1/2010 | Igawa et al. |
| 2010/0028637 A1 | 2/2010 | Tavsanli et al. |
| 2010/0261620 A1 | 10/2010 | Almagro et al. |
| 2010/0286374 A1 | 11/2010 | Kannan et al. |
| 2011/0052488 A1 | 3/2011 | Dennis, Jr. et al. |
| 2011/0123532 A1 | 5/2011 | Gurney et al. |
| 2012/0149876 A1 | 6/2012 | von Kreudenstein et al. |
| 2013/0078249 A1 | 3/2013 | Ast et al. |
| 2013/0195849 A1 | 8/2013 | von Kreudenstein et al. |
| 2015/0119555 A1 | 4/2015 | Jung et al. |
| 2017/0029506 A1 | 2/2017 | Van de Vliet et al. |
| 2017/0145086 A1 | 5/2017 | Myette et al. |
| 2019/0144540 A1 | 5/2019 | Koide et al. |
| 2019/0352397 A1 | 11/2019 | Takahashi et al. |
| 2021/0032338 A1 | 2/2021 | Ganesan et al. |
| 2021/0284730 A1 | 9/2021 | Ganesan et al. |
| 2021/0284731 A1 | 9/2021 | Ganesan et al. |
| 2022/0306739 A1 | 9/2022 | Ganesan et al. |

FOREIGN PATENT DOCUMENTS

| | | |
|---|---|---|
| WO | WO 2006028936 A2 | 3/2006 |
| WO | WO 2006028936 A3 | 3/2006 |
| WO | WO 2009018386 A1 | 2/2009 |
| WO | WO 2009080251 A1 | 7/2009 |
| WO | WO 2009080252 A1 | 7/2009 |
| WO | WO 2009080254 A1 | 7/2009 |
| WO | WO 2011131746 A2 | 10/2011 |
| WO | WO 2011131746 A3 | 10/2011 |
| WO | WO 2012018767 A2 | 2/2012 |
| WO | WO 2012018767 A3 | 2/2012 |
| WO | WO 2015156673 A1 | 10/2015 |
| WO | WO 2016196237 A1 | 12/2016 |
| WO | WO 2020227457 A1 | 11/2020 |
| WO | WO 2021173896 A1 | 9/2021 |
| WO | WO 2021183845 A1 | 9/2021 |

OTHER PUBLICATIONS

Vajdos et al. (J Mol Biol. Jul. 5, 2002;320(2):415-28). (Year: 2002).*
Bedouelle et al. (FEBS J. Jan. 2006;273(1):34-46). (Year: 2006).*
Brown et al. (J Immunol. May 1, 1996;156(9):3285-91). (Year: 1996).*
Rudikoff et al. (Proc. Natl. Acad. Sci. USA, 79: 1979-1983, Mar. 1982). (Year: 1982).*
Colman (Research in Immunology, 145:33-36, 1994). (Year: 1994).*
Al-Lazikani et al., 1997, "Standard conformations for the canonical structures of immunoglobulins," J. Mol. Biol., 273(4):927-948.
Altschul et al., 1990, "Basic local alignment search tool," J. Mol. Biol., 215(3):403-410.
Altschul et al., 1997, "Gapped BLAST and PSI-BLAST: a new generation of protein database search programs," Nucleic Acids Res., 25(17):3389-3402.

(Continued)

*Primary Examiner* — Zachary S Skelding
(74) *Attorney, Agent, or Firm* — TROUTMAN PEPPER HAMILTON SANDERS LLP

(57) ABSTRACT

Provided herein, in certain aspects, are antibodies that bind to T cell receptor (TCR) Vγ9 (TRGV9), TCR Vδ2 (TRDV2), or the TCR gamma/delta constant region (TRGDC), as well as recombinant cells containing the vectors, and compositions comprising the antibodies. Methods of making and using the antibodies are also provided.

13 Claims, No Drawings

Specification includes a Sequence Listing.

(56) References Cited

OTHER PUBLICATIONS

Atwell et al., 1997, "Stable heterodimers from remodeling the domain interface of a homodimer using a phage display library," J. Mol. Biol., 270(1):26-35.
Belver et al., 2016, "The genetics and mechanisms of T cell acute lymphoblastic leukaemia," Nat. Rev. Cancer, 16(8):494-507.
Brown et al., 1998, "Affinity purification of human IgG using immobilised, mutated immunoglobulin-binding domains from protein A of *Staphylococcus aureus*," Biochem. Soc. Trans., 26(3):S249.
Bruin et al., 2017, "A bispecific nanobody approach to leverage the potent and widely applicable tumor cytolytic capacity of Vγ9Vδ2-T cells," Oncoimmunology, 7(1):e1375641 (15 pages).
Chames et al., 2009, "Bispecific antibodies for cancer therapy," Curr. Opin. Drug Discov. Devel., 12(2):276-283.
Chothia et al., 1987, "Canonical structures for the hypervariable regions of immunoglobulins," J. Mol. Biol., 196(4):901-917.
D'Asaro et al., 2010, "V gamma 9V delta 2 T lymphocytes efficiently recognize and kill zoledronate-sensitized, imatinib-sensitive, and imatinib-resistant chronic myelogenous leukemia cells," J. Immunol., 184(6):3260-3268.
Ebersbach et al., 2007, "Affilin-novel binding molecules based on human gamma-B-crystallin, an all beta-sheet protein," J. Mol. Biol., 372(1):172-185.
Ferrara et al., 2006, "Modulation of therapeutic antibody effector functions by glycosylation engineering: influence of Golgi enzyme localization domain and co-expression of heterologous beta1, 4-N-acetylglucosaminyltransferase III and Golgi alpha-mannosidase II," Biotechnol. Bioeng., 93(5):851-861.
Ferrara et al., 2006, "The carbohydrate at FcgammaRIIIa Asn-162. An element required for high affinity binding to non-fucosylated IgG glycoforms," J. Biol. Chem., 281(8):5032-5036 (Epub 2005).
Friedrich et al., 2014, "Preclinical characterization of AMG 330, a CD3/CD33-bispecific T-cell-engaging antibody with potential for treatment of acute myelogenous leukemia," Mol. Cancer Ther., 13(6):1549-1557.
Ganesan et al., 2021, "Selective recruitment of γδ T cells by a bispecific antibody for the treatment of acute myeloid leukemia," Leukemia, 35(8):2274-2284.
Gebauer et al., 2009, "Engineered protein scaffolds as next-generation antibody therapeutics," Curr. Opin. Chem. Biol., 13(3):245-255.
GenBank Accession No. AY789109.1 (UniProt P26951), "Interleukin-3 receptor subunit alpha · *Homo sapiens* (Human) · Gene: IL3RA (IL3R)," retrieved from internet <https://beta.uniprot.org/uniprotkb/P26951/entry> on Mar. 23, 2022, last released Feb. 23, 2022 (10 pages).
GenBank Accession No. BC028152.1 (UniProt P20138), "Myeloid cell surface antigen CD33 · *Homo sapiens* (Human) · Gene: CD33 (SIGLEC3)," retrieved from internet <https://beta.uniprot.org/uniprotkb/P20138/entry> on Mar. 23, 2022, last released Feb. 23, 2022 (12 pages).
GenBank Accession No. NC_000007.14 (TRGC1), "*Homo sapiens* chromosome 7, GRCh38.p14 Primary Assembly," retrieved from internet <https://www.ncbi.nlm.nih.gov/nuccore/NC_000007.14?strand=2&report=genbank&from=38257879&to=38265678> on Sep. 20, 2022, last updated Apr. 6, 2022 (5 pages).
GenBank Accession No. NC_000007.14 (TRGC2), "*Homo sapiens* chromosome 7, GRCh38.p14 Primary Assembly," retrieved from internet <https://www.ncbi.nlm.nih.gov/nuccore/NC_000007.14?strand=2&report=genbank&from=38239580&to=38249572> on Sep. 20, 2022, last updated Apr. 6, 2022 (5 pages).
GenBank Accession No. NG_001336.2 (UniProt Q99603), "T cell receptor gamma variable 9 · *Homo sapiens* (Human) · Gene: TRGV9 (TCRGV9)," retrieved from internet <https://beta.uniprot.org/uniprotkb/Q99603/entry> on Mar. 23, 2022, last released Feb. 23, 2022 (8 pages).
Godwin et al., 2017, "Gemtuzumab ozogamicin in acute myeloid leukemia," Leukemia, 31(9):1855-1868.
Grabulovski et al., 2007, "A novel, non-immunogenic Fyn SH3-derived binding protein with tumor vascular targeting properties," J. Biol. Chem., 282(5):3196-3204 (Epub 2006).
Hamuro et al., 2003, "Rapid analysis of protein structure and dynamics by hydrogen/deuterium exchange mass spectrometry," J. Biomol. Tech., 14(3):171-182.
Henikoff et al., 1992, "Amino acid substitution matrices from protein blocks," Proc. Natl. Acad. Sci. USA, 89(22):10915-10919.
Honegger et al., 2001, "Yet another numbering scheme for immunoglobulin variable domains: an automatic modeling and analysis tool," J. Mol. Biol., 309(3):657-670.
Horn et al., 2006, "The role of protein dynamics in increasing binding affinity for an engineered protein—protein interaction established by H/D exchange mass spectrometry," Biochemistry, 45(28):8488-8498.
Huang et al., 2018, "Hydrogen/deuterium exchange mass spectrometry and computational modeling reveal a discontinuous epitope of an antibody/TL1A Interaction," mAbs, 10(1):95-103 (Epub 2017).
International Search Authority, International Search Report and Written Opinion for International Patent Application No. PCT/US2020/031749 (Pub No. WO 2020227457) mailed Oct. 9, 2020 (16 pages).
International Search Authority, International Search Report and Written Opinion for International Patent Application No. PCT/US2021/019766 (Pub No. WO 2021173896) mailed Jul. 1, 2021 (10 pages).
International Search Authority, International Search Report and Written Opinion for International Patent Application No. PCT/US2021/022049 (Pub No. WO 2021183845) mailed Aug. 2, 2021 (12 pages).
International Search Authority, International Search Report and Written Opinion for International Patent Application No. PCT/US2021/056744 (Pub No. WO 2022093888) mailed Mar. 2, 2022 (12 pages).
Itohara et al., 1990, "Selection of gamma delta T cells with canonical T-cell antigen receptors in fetal thymus," Proc. Natl. Acad. Sci. USA, 87(20):7935-7938.
Kabat et al., 1977, "Unusual distributions of amino acids in complementarity-determining (hypervariable) segments of heavy and light chains of immunoglobulins and their possible roles in specificity of antibody-combining sites," J. Biol. Chem., 252(19):6609-6616.
Kabat, 1978, "The structural basis of antibody complementarity," Adv. Protein. Chem., 32:1-75.
Karlin et al., 1993, "Applications and statistics for multiple high-scoring segments in molecular sequences," Proc. Natl. Acad. Sci. USA, 90(12):5873-5877.
Kiladjian et al., 2008, "Activation of cytotoxic T-cell receptor gammadelta T lymphocytes in response to specific stimulation in myelodysplastic syndromes," Haematologica, 93(3):381-389.
Kirkland et al., 1986, "Analysis of the fine specificity and cross-reactivity of monoclonal anti-lipid A antibodies," J. Immunol., 137(11):3614-3619.
Koide et al., 2007, "Monobodies: antibody mimics based on the scaffold of the fibronectin type III domain," Methods Mol. Biol., 352:95-109.
Kolmar, 2008, "Alternative binding proteins: biological activity and therapeutic potential of cystine-knot miniproteins," FEBS J., 275(11):2684-2690.
Konno et al., 2012, "Fucose content of monoclonal antibodies can be controlled by culture medium osmolality for high antibody-dependent cellular cytotoxicity," Cytotechnology, 64(3):249-265 (Epub 2011).
Krehenbrink et al., 2008, "Artificial binding proteins (Affitins) as probes for conformational changes in secretin PulD," J. Mol. Biol., 383(5):1058-1068.
Lamba et al., 2017, "CD33 Splicing Polymorphism Determines Gemtuzumab Ozogamicin Response in De Novo Acute Myeloid Leukemia: Report From Randomized Phase III Children's Oncology Group Trial AAML0531," J. Clin. Oncol., 35(23):2674-2682.
Laszlo et al., 2014, "The past and future of CD33 as therapeutic target in acute myeloid leukemia," Blood Rev., 28(4):143-153.

(56) References Cited

OTHER PUBLICATIONS

Laszlo et al., 2016, "Expression and functional characterization of CD33 transcript variants in human acute myeloid leukemia," Oncotarget, 7(28):43281-43294.

Lefranc et al., 2003, "IMGT unique numbering for immunoglobulin and T cell receptor variable domains and Ig superfamily V-like domains," Dev. Comp. Immunol., 27(1):55-77.

Legut et al., 2015, "The promise of γδ T cells and the γδ T cell receptor for cancer immunotherapy," Cell Mol. Immunol., 12(6):656-668.

Litzow et al., 2015, "How I treat T-cell acute lymphoblastic leukemia in adults," Blood, 126(7):833-841.

Liu et al., 2017, "The genomic landscape of pediatric and young adult T-lineage acute lymphoblastic leukemia," Nat. Genet., 49(8):1211-1218 and Online Methods (10 pages).

Martin, 2010, "Chapter 3: Protein Sequence and Structure Analysis of Antibody Variable Domains," in Antibody Engineering vol. 2, Second Edition, Kontermann et al. eds., Springer, pp. 33-51.

Moldenhauer et al., 1990, "Identity of HML-1 antigen on intestinal intraepithelial T cells and of B-ly7 antigen on hairy cell leukaemia," Scand. J. Immunol., 32(2):77-82.

Morea et al., 2000, "Antibody modeling: implications for engineering and design," Methods, 20(3):267-279.

Morel et al., 1988, "Monoclonal antibodies to bovine serum albumin: affinity and specificity determinations," Mol. Immunol., 25(1):7-15.

Mori et al., 2004, "Engineering Chinese hamster ovary cells to maximize effector function of produced antibodies using FUT8 siRNA," Biotechnol. Bioeng., 88(7):901-908.

Needleman et al., 1970, "A general method applicable to the search for similarities in the amino acid sequence of two proteins," J. Mol. Biol., 48(3):443-453.

Nixon et al., 2006, "Engineered protein inhibitors of proteases," Curr. Opin. Drug Discov. Devel., 9(2):261-268.

Nunez-Prado et al., 2015, "The coming of age of engineered multivalent antibodies," Drug Discov. Today, 20(5):588-594.

Nygren, 2008, "Alternative binding proteins: affibody binding proteins developed from a small three-helix bundle scaffold," FEBS J., 275(11):2668-2676.

Oberg et al., 2014, "Novel bispecific antibodies increase γδ T-cell cytotoxicity against pancreatic cancer cells," Cancer Res., 74(5):1349-1360.

Oberg et al., 2015, "γδ T cell activation by bispecific antibodies," Cell Immunol., 296(1):41-49.

Olivier et al., 2010, "EB66 cell line, a duck embryonic stem cell-derived substrate for the industrial production of therapeutic monoclonal antibodies with enhanced ADCC activity," mAbs, 2(4):405-415.

Pascal et al., 2012, "HDX workbench: software for the analysis of H/D exchange MS data," J. Am. Soc. Mass Spectrom., 23(9):1512-1521.

Pearson et al., 1988, "Improved tools for biological sequence comparison," Proc. Natl. Acad. Sci. USA, 85(8):2444-2448.

Pui et al., 2015, "Childhood Acute Lymphoblastic Leukemia: Progress Through Collaboration," J. Clin. Oncol., 33(27):2938-2948.

Shields et al., 2002, "Lack of fucose on human IgG1 N-linked oligosaccharide improves binding to human Fcgamma RIII and antibody-dependent cellular toxicity," J. Biol. Chem., 277(30):26733-26740.

Shinkawa et al., 2003, "The absence of fucose but not the presence of galactose or bisecting N-acetylglucosamine of human IgG1 complex-type oligosaccharides shows the critical role of enhancing antibody-dependent cellular cytotoxicity," J. Biol. Chem., 278(5):3466-3473 (Epub 2002).

Silverman et al., 2005, "Multivalent avimer proteins evolved by exon shuffling of a family of human receptor domains," Nat. Biotechnol., 23(12):1556-1561.

Singh et al., 2015, "Selective targeting of the IL23 pathway: Generation and characterization of a novel high-affinity humanized anti-IL23A antibody," mAbs, 7(4):778-791.

Skerra, 2008, "Alternative binding proteins: anticalins—harnessing the structural plasticity of the lipocalin ligand pocket to engineer novel binding activities" FEBS J., 275(11):2677-2683.

Smith et al., 1981, "Comparison of biosequences," Advances in Applied Mathematics, 2(4):482-489.

Stahli et al., 1983, "Distinction of epitopes by monoclonal antibodies," Methods Enzymol., 92:242-253.

Stumpp et al., 2008, "DARPins: a new generation of protein therapeutics," Drug Discov. Today, 13(15-16):695-701.

Vasu et al., 2016, "Decitabine enhances anti-CD33 monoclonal antibody BI 836858-mediated natural killer ADCC against AML blasts," Blood, 127(23):2879-2889.

Wesselborg et al., 1991, "Selective activation of gamma/delta + T cell clones by single anti-CD2 antibodies," J. Exp. Med., 173(2):297-304.

Wranik et al., 2012, "LUZ-Y, a novel platform for the mammalian cell production of full-length IgG-bispecific antibodies," J. Biol. Chem., 287(52):43331-43339.

Zhang et al., 2019, "CellMarker: a manually curated resource of cell markers in human and mouse," Nucleic Acids Res., 47(D1):D721-D728 (Epub 2018).

Zhao et al., 2018, "Gamma-delta (γδ) T cells: friend or foe in cancer development?" J. Transl. Med., 16(1):3 (13 pages).

Zhou et al., 2008, "Development of a simple and rapid method for producing non-fucosylated oligomannose containing antibodies with increased effector function," Biotechnol. Bioeng., 99(3):652-665.

\* cited by examiner

COMPOSITIONS AND METHODS FOR MODULATING DELTA GAMMA CHAIN MEDIATED IMMUNITY

CROSS-REFERENCE TO RELATED APPLICATIONS

This application claims the benefit of U.S. Ser. No. 63/106,703 filed Oct. 28, 2020; the disclosure of which is incorporated by reference herein in its entirety.

FIELD

Provided herein, in certain aspects, are antibodies that bind to T cell receptor (TCR) Vγ9 (TRGV9), TCR Vδ2 (TRDV2), or the TCR gamma/delta constant region (TRGDC), as well as recombinant cells containing the vectors, and compositions comprising the antibodies. Methods of making and using the antibodies are also provided.

REFERENCE TO SEQUENCE LISTING SUBMITTED ELECTRONICALLY

This application contains a sequence listing, which is submitted electronically via EFS-Web as an ASCII formatted sequence listing with a file name of "14620-236-999_SL.txt" and a creation date of Oct. 7, 2021 and having a size of 2,092,175 bytes. The sequence listing submitted via EFS-Web is part of the specification and is herein incorporated by reference in its entirety.

SUMMARY

In one aspect, provided herein is an antibody that binds TRGV9. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970. In one embodiment, the TRGV9 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004.

In some embodiments, the VH CDR1, VH CDR2, VH CDR3, VL CDR1, VL CDR2, and VL CDR3 amino acid sequences of the TRGV9 antibody are according to the Kabat numbering system. In some embodiments, the VH CDR1, VH CDR2, VH CDR3, VL CDR1, VL CDR2, and VL CDR3 amino acid sequences of the TRGV9 antibody are according to the Chothia numbering system. In some embodiments, the VH CDR1, VH CDR2, VH CDR3, VL CDR1, VL CDR2, and VL CDR3 amino acid sequences of the TRGV9 antibody are according to the AbM numbering system. In some embodiments, the VH CDR1, VH CDR2, VH CDR3, VL CDR1, VL CDR2, and VL CDR3 amino acid sequences of the TRGV9 antibody are according to the Contact numbering system. In some embodiments, the VH CDR1, VH CDR2, VH CDR3, VL CDR1, VL CDR2, and VL CDR3 amino acid sequences of the TRGV9 antibody are according to the IMGT numbering system.

In some embodiments, the antibody binds a TRGV9 antigen. In some embodiments, antibody binds a TRGV9 epitope. In some embodiments, the antibody specifically binds to TRGV9. In some embodiments, the VH CDR1, VH CDR2, VH CDR3, VL CDR1, VL CDR2 and VL CDR3 form a binding site for an antigen of the TRGV9. In some embodiments, the VH CDR1, VH CDR2, VH CDR3, VL CDR1, VL CDR2 and VL CDR3 form a binding site for an epitope of the TRGV9. In some embodiments, the TRGV9 is present on the surface of a T cell.

In some embodiments, the TRGV9 antibody is a humanized antibody. In some embodiments, the antibody is an IgG antibody. In some embodiments, the TRGV9 antibody is an IgG1 antibody. In some embodiments, the TRGV9 antibody is an IgG2 antibody. In some embodiments, the TRGV9 antibody is an IgG3 antibody. In some embodiments, the TRGV9 antibody is an IgG4 antibody. In some embodiments, the TRGV9 antibody comprises a kappa light chain. In some embodiments, the TRGV9 the antibody comprises a lambda light chain. In some embodiments, the TRGV9 antibody is a monoclonal antibody. In some embodiments, the TRGV9 antibody is multivalent. In some embodiments, the TRGV9 antibody is capable of binding at least three antigens. In some embodiments, the TRGV9 antibody is capable of binding at least five antigens. In some embodiments, the TRGV9 antibody is a multispecific antibody. In some embodiments, the TRGV9 antibody is a bispecific antibody.

In another aspect, provided is a nucleic acid sequence encoding a TRGV9 antibody provided herein. Also provided is a vector comprising a nucleic acid sequence encoding a TRGV9 antibody provided herein. Also provided is a host cell comprising a vector comprising a nucleic acid sequence encoding a TRGV9 antibody provided herein. Also provided is a kit comprising vector comprising a nucleic acid sequence encoding a TRGV9 antibody provided herein, and packaging for the same.

In another aspect, provided is a kit comprising a TRGV9 antibody provided herein, and packaging for the same.

In another aspect, provided is a pharmaceutical composition comprising a TRGV9 antibody provided herein, and a pharmaceutically acceptable carrier.

In another aspect, provided is a method of producing a pharmaceutical composition comprising a TRGV9 antibody provided herein, comprising combining the TRGV9 antibody with a pharmaceutically acceptable carrier to obtain the pharmaceutical composition.

In another aspect, provided is a method of activating a T cell expressing TRGV9, comprising contacting the T cell with a TRGV9 antibody provided herein. In certain embodiments, the contacting results in an increase in CD69, CD25, and/or Granzyme B expression, as compared to a control T cell expressing TRGV9.

In another aspect, provided herein is an antibody that binds TRDV2. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2207; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2208. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2241; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2242. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2275; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2276. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2309; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2310. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2343; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2344. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2377; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2378. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2411; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2412. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2445; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2446. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2479; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2480. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2513; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2514. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2547; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2548. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2581; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2582. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2615; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2616. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2649; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2650. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2683; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2684. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2717; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2718. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2751; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2752. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2785; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2786. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2819; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2820. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2853; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2854. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2887; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2888. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2921; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2922. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2955; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2956. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2989; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2990. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3023; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3024. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3057; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3058. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3091; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3092. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3125; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3126. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3159; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3160. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3193; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3194. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3227; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3228. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3261; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3262. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3295; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3296. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3329; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3330. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3363; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3364. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3397; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3398. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3431; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3432. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3465; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3466. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3499; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3500. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3533; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3534. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3567; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3568. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3601; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3602. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3635; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3636. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3669; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3670. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3703; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3704. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3737; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3738. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3771; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3772. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3805; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3806. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3839; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3840. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3873; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3874. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3907; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3908. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3941; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3942. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3975; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3976. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4009; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4010. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4043; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4044. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4077; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4078. In one embodiment, the TRDV2 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4111; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4112.

In some embodiments, the VH CDR1, VH CDR2, VH CDR3, VL CDR1, VL CDR2, and VL CDR3 amino acid sequences of the TRDV2 antibody are according to the Kabat numbering system. In some embodiments, the VH CDR1, VH CDR2, VH CDR3, VL CDR1, VL CDR2, and VL CDR3 amino acid sequences of the TRDV2 antibody are according to the Chothia numbering system. In some embodiments, the VH CDR1, VH CDR2, VH CDR3, VL CDR1, VL CDR2, and VL CDR3 amino acid sequences of the TRDV2 antibody are according to the AbM numbering system. In some embodiments, the VH CDR1, VH CDR2, VH CDR3, VL CDR1, VL CDR2, and VL CDR3 amino acid sequences of the TRDV2 antibody are according to the Contact numbering system. In some embodiments, the VH CDR1, VH CDR2, VH CDR3, VL CDR1, VL CDR2, and VL CDR3 amino acid sequences of the TRDV2 antibody are according to the IMGT numbering system.

In some embodiments, the antibody binds a TRDV2 antigen. In some embodiments, antibody binds a TRDV2 epitope. In some embodiments, the antibody specifically binds to TRDV2. In some embodiments, the VH CDR1, VH CDR2, VH CDR3, VL CDR1, VL CDR2 and VL CDR3 form a binding site for an antigen of the TRDV2. In some embodiments, the VH CDR1, VH CDR2, VH CDR3, VL CDR1, VL CDR2 and VL CDR3 form a binding site for an epitope of the TRDV2. In some embodiments, the TRDV2 is present on the surface of a T cell.

In some embodiments, the TRDV2 antibody is a humanized antibody. In some embodiments, the antibody is an IgG antibody. In some embodiments, the TRDV2 antibody is an IgG1 antibody. In some embodiments, the TRDV2 antibody is an IgG2 antibody. In some embodiments, the TRDV2 antibody is an IgG3 antibody. In some embodiments, the TRDV2 antibody is an IgG4 antibody. In some embodiments, the TRDV2 antibody comprises a kappa light chain. In some embodiments, the TRDV2 the antibody comprises a lambda light chain. In some embodiments, the TRDV2 antibody is a monoclonal antibody. In some embodiments, the TRDV2 antibody is multivalent. In some embodiments, the TRDV2 antibody is capable of binding at least three antigens. In some embodiments, the TRDV2 antibody is capable of binding at least five antigens. In some embodiments, the TRDV2 antibody is a multispecific antibody. In some embodiments, the TRDV2 antibody is a bispecific antibody.

In another aspect, provided is a nucleic acid sequence encoding a TRDV2 antibody provided herein. Also provided is a vector comprising a nucleic acid sequence encoding a TRDV2 antibody provided herein. Also provided is a host cell comprising a vector comprising a nucleic acid sequence encoding a TRDV2 antibody provided herein. Also provided is a kit comprising vector comprising a nucleic acid sequence encoding a TRDV2 antibody provided herein, and packaging for the same.

In another aspect, provided is a kit comprising a TRDV2 antibody provided herein, and packaging for the same.

In another aspect, provided is a pharmaceutical composition comprising a TRDV2 antibody provided herein, and a pharmaceutically acceptable carrier.

In another aspect, provided is a method of producing a pharmaceutical composition comprising a TRDV2 antibody provided herein, comprising combining the TRDV2 antibody with a pharmaceutically acceptable carrier to obtain the pharmaceutical composition.

In another aspect, provided is a method of activating a T cell expressing TRDV2, comprising contacting the T cell with a TRDV2 antibody provided herein. In certain embodiments, the contacting results in an increase in CD69, CD25, and/or Granzyme B expression, as compared to a control T cell expressing TRDV2.

In another aspect, provided herein is an antibody that binds TRGDC. In one embodiment, the TRGDC antibody comprises: In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4145; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4146. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4179; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4180. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4213; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4214. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4247; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4248. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4281; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4282. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4315; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4316. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4349; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4350. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4383; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4384. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4417; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4418. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4451; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4452. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4485; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4486. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4519; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4520. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4553; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4554. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4587; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4588. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4621; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4622. In one embodiment, the TRGDC antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4655; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4656.

In some embodiments, the VH CDR1, VH CDR2, VH CDR3, VL CDR1, VL CDR2, and VL CDR3 amino acid sequences of the TRGDC antibody are according to the Kabat numbering system. In some embodiments, the VH CDR1, VH CDR2, VH CDR3, VL CDR1, VL CDR2, and VL CDR3 amino acid sequences of the TRGDC antibody are according to the Chothia numbering system. In some embodiments, the VH CDR1, VH CDR2, VH CDR3, VL CDR1, VL CDR2, and VL CDR3 amino acid sequences of the TRGDC antibody are according to the AbM numbering system. In some embodiments, the VH CDR1, VH CDR2, VH CDR3, VL CDR1, VL CDR2, and VL CDR3 amino acid sequences of the TRGDC antibody are according to the Contact numbering system. In some embodiments, the VH CDR1, VH CDR2, VH CDR3, VL CDR1, VL CDR2, and VL CDR3 amino acid sequences of the TRGDC antibody are according to the IMGT numbering system.

In some embodiments, the antibody binds a TRGDC antigen. In some embodiments, antibody binds a TRGDC epitope. In some embodiments, the antibody specifically binds to TRGDC. In some embodiments, the VH CDR1, VH CDR2, VH CDR3, VL CDR1, VL CDR2 and VL CDR3 form a binding site for an antigen of the TRGDC. In some embodiments, the VH CDR1, VH CDR2, VH CDR3, VL CDR1, VL CDR2 and VL CDR3 form a binding site for an epitope of the TRGDC. In some embodiments, the TRGDC is present on the surface of a T cell.

In some embodiments, the TRGDC antibody is a humanized antibody. In some embodiments, the antibody is an IgG antibody. In some embodiments, the TRGDC antibody is an IgG1 antibody. In some embodiments, the TRGDC antibody is an IgG2 antibody. In some embodiments, the TRGDC antibody is an IgG3 antibody. In some embodiments, the TRGDC antibody is an IgG4 antibody. In some embodiments, the TRGDC antibody comprises a kappa light chain. In some embodiments, the TRGDC the antibody comprises a lambda light chain. In some embodiments, the TRGDC antibody is a monoclonal antibody. In some embodiments, the TRGDC antibody is multivalent. In some embodiments, the TRGDC antibody is capable of binding at least three antigens. In some embodiments, the TRGDC antibody is capable of binding at least five antigens. In some embodiments, the TRGDC antibody is a multispecific antibody. In some embodiments, the TRGDC antibody is a bispecific antibody.

In another aspect, provided is a nucleic acid sequence encoding a TRGDC antibody provided herein. Also provided is a vector comprising a nucleic acid sequence encoding a TRGDC antibody provided herein. Also provided is a host cell comprising a vector comprising a nucleic acid sequence encoding a TRGDC antibody provided herein. Also provided is a kit comprising vector comprising a nucleic acid sequence encoding a TRGDC antibody provided herein, and packaging for the same.

In another aspect, provided is a kit comprising a TRGDC antibody provided herein, and packaging for the same.

In another aspect, provided is a pharmaceutical composition comprising a TRGDC antibody provided herein, and a pharmaceutically acceptable carrier.

In another aspect, provided is a method of producing a pharmaceutical composition comprising a TRGDC antibody provided herein, comprising combining the TRGDC antibody with a pharmaceutically acceptable carrier to obtain the pharmaceutical composition.

In another aspect, provided is a method of activating a T cell expressing TRGDC, comprising contacting the T cell with a TRGDC antibody provided herein. In certain embodiments, the contacting results in an increase in CD69, CD25, and/or Granzyme B expression, as compared to a control T cell expressing TRGDC.

DETAILED DESCRIPTION

Various publications, articles and patents are cited or described in the background and throughout the specification; each of these references is herein incorporated by reference in its entirety. Discussion of documents, acts, materials, devices, articles or the like which has been included in the present specification is for the purpose of providing context for the invention. Such discussion is not an admission that any or all of these matters form part of the prior art with respect to any inventions disclosed or claimed.

Unless defined otherwise, all technical and scientific terms used herein have the same meaning as commonly understood to one of ordinary skill in the art to which this invention pertains. Otherwise, certain terms used herein have the meanings as set forth in the specification.

It must be noted that as used herein and in the appended claims, the singular forms "a," "an," and "the" include plural reference unless the context clearly dictates otherwise.

Unless otherwise stated, any numerical values, such as a concentration or a concentration range described herein, are to be understood as being modified in all instances by the term "about." Thus, a numerical value typically includes ±10% of the recited value. For example, a concentration of 1 mg/mL includes 0.9 mg/mL to 1.1 mg/mL. Likewise, a concentration range of 1% to 10% (w/v) includes 0.9% (w/v) to 11% (w/v). As used herein, the use of a numerical range expressly includes all possible subranges, all individual numerical values within that range, including integers within such ranges and fractions of the values unless the context clearly indicates otherwise.

Unless otherwise indicated, the term "at least" preceding a series of elements is to be understood to refer to every element in the series.

Those skilled in the art will recognize or be able to ascertain using no more than routine experimentation, many equivalents to the specific embodiments described herein. Such equivalents are intended to been compassed by the invention.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers and are intended to be non-exclusive or open-ended. For example, a composition, a mixture, a process, a method, an article, or an apparatus that comprises a list of elements is not necessarily limited to only those elements but can include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the conjunctive term "and/or" between multiple recited elements is understood as encompassing both individual and combined options. For instance, where two elements are conjoined by "and/or," a first option refers to the applicability of the first element without the second. A second option refers to the applicability of the second element without the first. A third option refers to the applicability of the first and second elements together. Any one of these options is understood to fall within the meaning, and therefore satisfy the requirement of the term "and/or" as used herein. Concurrent applicability of more than one of the options is also understood to fall within the meaning, and therefore satisfy the requirement of the term "and/or."

As used herein, the term "consists of," or variations such as "consist of" or "consisting of," as used throughout the specification and claims, indicate the inclusion of any recited integer or group of integers, but that no additional integer or group of integers can be added to the specified method, structure, or composition.

As used herein, the term "consists essentially of" or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure or composition. See M.P.E.P. § 2111.03.

As used herein, "subject" means any animal, preferably a mammal, most preferably a human. The term "mammal" as used herein, encompasses any mammal. Examples of mammals include, but are not limited to, cows, horses, sheep, pigs, cats, dogs, mice, rats, rabbits, guinea pigs, monkeys, humans, etc. In a specific embodiments, the subject is a human.

It should also be understood that the terms "about," "approximately," "generally," "substantially," and like terms, used herein when referring to a dimension or characteristic of a component of embodiments provided herein, indicate that the described dimension/characteristic is not a strict boundary or parameter and does not exclude minor variations therefrom that are functionally the same or similar, as would be understood by one having ordinary skill in the art. At a minimum, such references that include a numerical parameter would include variations that, using mathematical and industrial principles accepted in the art (e.g., rounding, measurement or other systematic errors, manufacturing tolerances, etc.), would not vary the least significant digit.

The terms "identical" or percent "identity," in the context of two or more nucleic acids or polypeptide sequences (e.g., TRGV9 antibody and polynucleotides that encode them, TRDV2 antibody and polynucleotides that encode them, or TRGDC antibody and polynucleotides that encode them), refer to two or more sequences or subsequences that are the same or have a specified percentage of amino acid residues or nucleotides that are the same, when compared and aligned for maximum correspondence, as measured using one of the following sequence comparison algorithms or by visual inspection.

For sequence comparison, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, WI), or by visual inspection (see generally, Current Protocols in Molecular Biology, F. M. Ausubel et al., eds., Current Protocols, a joint venture between Greene Publishing Associates, Inc. and John Wiley & Sons, Inc., (1995 Supplement) (Ausubel)).

Examples of algorithms that are suitable for determining percent sequence identity and sequence similarity are the BLAST and BLAST 2.0 algorithms, which are described in Altschul et al. (1990) J. Mol. Biol. 215: 403-410 and Altschul et al. (1997) Nucleic Acids Res. 25: 3389-3402, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased.

Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a word length (W) of 11, an expectation (E) of 10, M=5, N=−4, and a comparison of both strands. For amino acid sequences, the BLASTP program uses as defaults a word length (W) of 3, an expectation (E) of 10, and the BLOSUM62 scoring matrix (see Henikoff & Henikoff, Proc. Natl. Acad. Sci. USA 89:10915 (1989)).

In addition to calculating percent sequence identity, the BLAST algorithm also performs a statistical analysis of the similarity between two sequences (see, e.g., Karlin & Altschul, Proc. Nat'l. Acad. Sci. USA 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

A further indication that two nucleic acid sequences or polypeptides are substantially identical is that the polypeptide encoded by the first nucleic acid is immunologically cross reactive with the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules hybridize to each other under stringent conditions.

As used herein, the term "polynucleotide," synonymously referred to as "nucleic acid molecule," "nucleotides" or "nucleic acids," refers to any polyribonucleotide or polydeoxyribonucleotide, which can be unmodified RNA or DNA or modified RNA or DNA. "Polynucleotides" include, without limitation single- and double-stranded DNA, DNA that is a mixture of single- and double-stranded regions, single- and double-stranded RNA, and RNA that is mixture of single- and double-stranded regions, hybrid molecules comprising DNA and RNA that can be single-stranded or, more typically, double-stranded or a mixture of single- and double-stranded regions. In addition, "polynucleotide" refers to triple-stranded regions comprising RNA or DNA or both RNA and DNA. The term polynucleotide also includes DNAs or RNAs containing one or more modified bases and DNAs or RNAs with backbones modified for stability or for other reasons. "Modified" bases include, for example, tritylated bases and unusual bases such as inosine. A variety of modifications can be made to DNA and RNA; thus, "polynucleotide" embraces chemically, enzymatically or metabolically modified forms of polynucleotides as typically found in nature, as well as the chemical forms of DNA and RNA characteristic of viruses and cells. "Polynucleotide" also embraces relatively short nucleic acid chains, often referred to as oligonucleotides.

As used herein, the term "vector" is a replicon in which another nucleic acid segment can be operably inserted so as to bring about the replication or expression of the segment.

As used herein, the term "host cell" refers to a cell comprising a nucleic acid molecule provided herein. The "host cell" can be any type of cell, e.g., a primary cell, a cell in culture, or a cell from a cell line. In one embodiment, a "host cell" is a cell transfected with a nucleic acid molecule provided herein. In another embodiment, a "host cell" is a progeny or potential progeny of such a transfected cell. A progeny of a cell may or may not be identical to the parent cell, e.g., due to mutations or environmental influences that can occur in succeeding generations or integration of the nucleic acid molecule into the host cell genome.

The term "expression" as used herein, refers to the biosynthesis of a gene product. The term encompasses the transcription of a gene into RNA. The term also encompasses translation of RNA into one or more polypeptides, and further encompasses all naturally occurring post-transcriptional and post-translational modifications. The expressed antibody can be within the cytoplasm of a host cell, into the extracellular milieu such as the growth medium of a cell culture or anchored to the cell membrane.

As used herein, the terms "peptide," "polypeptide," or "protein" can refer to a molecule comprised of amino acids and can be recognized as a protein by those of skill in the art. The conventional one-letter or three-letter code for amino acid residues is used herein. The terms "peptide," "polypeptide," and "protein" can be used interchangeably herein to refer to polymers of amino acids of any length. The polymer can be linear or branched, it can comprise modified amino acids, and it can be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids, etc.), as well as other modifications known in the art.

The peptide sequences described herein are written according to the usual convention whereby the N-terminal region of the peptide is on the left and the C-terminal region is on the right. Although isomeric forms of the amino acids are known, it is the L-form of the amino acid that is represented unless otherwise expressly indicated.

Antibodies

Provided herein are TRGV9 antibodies or antigen-binding fragments thereof, nucleic acids and expression vectors encoding the antibodies, recombinant cells containing the vectors, and compositions comprising the antibodies. The antibodies disclosed herein possess one or more desirable functional properties, including but not limited to high-affinity binding to TRGV9 or high specificity to TRGV9. Also provided herein are TRDV2 antibodies or antigen-binding fragments thereof, nucleic acids and expression vectors encoding the antibodies, recombinant cells containing the vectors, and compositions comprising the antibodies. The antibodies disclosed herein possess one or more desirable functional properties, including but not limited to high-affinity binding to TRDV2 or high specificity to TRDV2. Also provided herein are antibodies or antigen-binding fragments thereof that bind TRGDC, nucleic acids and expression vectors encoding the antibodies, recombinant cells containing the vectors, and compositions comprising the antibodies. The antibodies disclosed herein possess one or more desirable functional properties, including but not limited to high-affinity binding to TRGDC or high specificity to TRGDC. Methods of making the antibodies, and methods of using the antibodies to treat diseases are also provided. In certain embodiments, the antibodies disclosed herein possess the ability to treat or prevent a disease or disorder when administered to a subject alone or in combination with other therapies.

As used herein, the term "antibody" is used in a broad sense and includes immunoglobulin or antibody molecules including human, humanized, composite and chimeric antibodies and antibody fragments that are monoclonal or polyclonal. In general, antibodies are proteins or peptide chains that exhibit binding specificity to a specific antigen. Antibody structures are well known. Immunoglobulins can be assigned to five major classes (i.e., IgA, IgD, IgE, IgG and IgM), depending on the heavy chain constant domain amino acid sequence. IgA and IgG are further sub-classified as the isotypes IgA1, IgA2, IgG1, IgG2, IgG3 and IgG4. Accordingly, the antibodies provided herein can be of any of the five major classes or corresponding sub-classes. In specific embodiments, the antibodies provided herein are IgG1, IgG2, IgG3 or IgG4. Antibody light chains of vertebrate species can be assigned to one of two clearly distinct types, namely kappa and lambda, based on the amino acid sequences of their constant domains. Accordingly, the antibodies provided herein can, in certain embodiments, contain a kappa light chain constant domain. The antibodies provided herein can, in certain embodiments, also contain a lambda light chain constant domain. According to particular embodiments, the antibodies provided herein include heavy and/or light chain constant regions from rat or human antibodies. In specific embodiments, the constant region is a human constant region.

In addition to the heavy and light constant domains, antibodies contain an antigen-binding region that is made up of a light chain variable region (VL) and a heavy chain variable region (VH), each of which contains three domains (i.e., complementarity determining regions 1 (CDR1), CDR2 and CDR3. A "CDR" refers to one of three hypervariable regions (HCDR1, HCDR2 or HCDR3) within the non-framework region of the immunoglobulin (Ig or antibody) VH β-sheet framework, or one of three hypervariable regions (LCDR1, LCDR2 or LCDR3) within the non-framework region of the antibody VL β-sheet framework. Accordingly, CDRs are variable region sequences interspersed within the framework region sequences. CDR regions are well known to those skilled in the art and have been defined by, for example, Kabat as the regions of most hypervariability within the antibody variable (V) domains (Kabat et al., *J. Biol. Chem.* 252:6609-6616 (1977); Kabat, *Adv. Prot. Chem.* 32:1-75 (1978)). CDR region sequences also have been defined structurally by Chothia as those residues that are not part of the conserved β-sheet framework, and thus are able to adapt different conformations (Chothia and Lesk, *J. Mol. Biol.* 196:901-917 (1987)). Both terminologies are well recognized in the art. CDR region sequences have also been defined by AbM, Contact and IMGT. Exemplary CDR region sequences are illustrated herein, for example, in the tables provided in the Examples below. The positions of CDRs within a canonical antibody variable region have been determined by comparison of numerous structures (Al-Lazikani et al., *J. Mol. Biol.* 273:927-948 (1997); Morea et al., *Methods* 20:267-279 (2000)). Because the number of residues within a hypervariable region varies in different antibodies, additional residues relative to the canonical positions are conventionally numbered with a, b, c and so forth next to the residue number in the canonical variable region numbering scheme (Al-Lazikani et al., supra (1997)). Such nomenclature is similarly well known to those skilled in the art.

The light chain variable region CDR1 domain is interchangeably referred to herein as LCDR1 or VL CDR1. The light chain variable region CDR2 domain is interchangeably referred to herein as LCDR2 or VL CDR2. The light chain variable region CDR3 domain is interchangeably referred to herein as LCDR3 or VL CDR3. The heavy chain variable region CDR1 domain is interchangeably referred to herein as HCDR1 or VH CDR1. The heavy chain variable region CDR2 domain is interchangeably referred to herein as HCDR2 or VH CDR2. The heavy chain variable region CDR1 domain is interchangeably referred to herein as HCDR3 or VH CDR3.

The term "hypervariable region", such as a VH or VL, when used herein refers to the regions of an antibody variable region that are hypervariable in sequence and/or form structurally defined loops. Generally, antibodies comprise six hypervariable regions; three in the VH (HCDR1, HCDR2, HCDR3), and three in the VL (LCDR1, LCDR2, LCDR3). A number of hypervariable region delineations are in use and are encompassed herein. The "Kabat" CDRs are based on sequence variability and are the most commonly used (see, e.g., Kabat et al., Sequences of Proteins of Immunological Interest, 5th Ed. Public Health Service, National Institutes of Health, Bethesda, MD (1991)). "Chothia" refers instead to the location of the structural loops (see, e.g., Chothia and Lesk, *J. Mol. Biol.* 196:901-917 (1987)). The end of the Chothia CDR-HCDR1 loop when numbered using the Kabat numbering convention varies between H32 and H34 depending on the length of the loop (this is because the Kabat numbering scheme places the insertions at H35A and H35B; if neither 35A nor 35B is present, the loop ends at 32; if only 35A is present, the loop ends at 33; if both 35A and 35B are present, the loop ends at 34). The "AbM" hypervariable regions represent a compromise between the Kabat CDRs and Chothia structural loops, and are used by Oxford Molecular's AbM antibody modeling software (see, e.g., Martin, in *Antibody Engineering*, Vol. 2, Chapter 3, Springer Verlag). "Contact" hypervariable regions are based on an analysis of the available complex crystal structures.

Recently, a universal numbering system has been developed and widely adopted, ImMunoGeneTics (IMGT) Information System® (Lafranc et al., *Dev. Comp. Immunol.* 27(1):55-77 (2003)). IMGT is an integrated information system specializing in immunoglobulins (IG), T cell receptors (TR) and major histocompatibility complex (WIC) of human and other vertebrates. Herein, the CDRs are referred to in terms of both the amino acid sequence and the location within the light or heavy chain. As the "location" of the CDRs within the structure of the immunoglobulin variable domain is conserved between species and present in structures called loops, by using numbering systems that align variable domain sequences according to structural features, CDR and framework residues are readily identified. This information can be used in grafting and replacement of CDR residues from immunoglobulins of one species into an acceptor framework from, typically, a human antibody. An additional numbering system (AHon) has been developed by Honegger and Plückthun, *J. Mol. Biol.* 309: 657-670 (2001). Correspondence between the numbering system, including, for example, the Kabat numbering and the IMGT unique numbering system, is well known to one skilled in the art (see, e.g., Kabat, supra; Chothia and Lesk, supra; Martin, supra; Lefranc et al., supra). An Exemplary system, shown herein, combines Kabat and Chothia.

|  | Exemplary | IMGT | Kabat | AbM | Chothia | Contact |
|---|---|---|---|---|---|---|
| $V_H$ CDR1 | 26-35 | 27-38 | 31-35 | 26-35 | 26-32 | 30-35 |
| $V_H$ CDR2 | 50-65 | 56-65 | 50-65 | 50-58 | 53-55 | 47-58 |
| $V_H$ CDR3 | 95-102 | 105-117 | 95-102 | 95-102 | 96-101 | 93-101 |
| $V_L$ CDR1 | 24-34 | 27-38 | 24-34 | 24-34 | 26-32 | 30-36 |
| $V_L$ CDR2 | 50-56 | 56-65 | 50-56 | 50-56 | 50-52 | 46-55 |
| $V_L$ CDR3 | 89-97 | 105-117 | 89-97 | 89-97 | 91-96 | 89-96 |

Hypervariable regions may comprise "extended hypervariable regions" as follows: 24-36 or 24-34 (LCDR1), 46-56 or 50-56 (LCDR2) and 89-97 or 89-96 (LCDR3) in the VL and 26-35 or 26-35A (HCDR1), 50-65 or 49-65 (HCDR2) and 93-102, 94-102, or 95-102 (HCDR3) in the VH. CDR sequences, reflecting each of the above numbering schemes, are provided herein, including in Tables 2-7.

The term "constant region" or "constant domain" refers to a carboxy terminal portion of the light and heavy chain which is not directly involved in binding of the antibody to antigen but exhibits various effector function, such as interaction with the Fc receptor. The terms refer to the portion of an immunoglobulin molecule having a more conserved amino acid sequence relative to the other portion of the immunoglobulin, the variable region, which contains the antigen binding site. The constant region may contain the CH1, CH2 and CH3 regions of the heavy chain and the CL region of the light chain.

The term "framework" or "FR" residues are those variable region residues flanking the CDRs. FR residues are present, for example, in chimeric, humanized, human, domain antibodies, diabodies, linear antibodies, and bispecific antibodies. FR residues are those variable domain residues other than the hypervariable region residues or CDR residues.

As used herein, the term an "isolated antibody" refers to an antibody which is substantially free of other antibodies having different antigenic specificities (e.g., an isolated antibody that specifically binds to TRGV9 is substantially free of antibodies that do not bind to TRGV9, or an isolated antibody that specifically binds to TRDV2 is substantially free of antibodies that do not bind to TRDV2, or an isolated antibody that specifically binds to TRGDC is substantially free of antibodies that do not bind to TRGDC). In addition, an isolated antibody is substantially free of other cellular material and/or chemicals.

As used herein, the term "monoclonal antibody" refers to an antibody obtained from a population of substantially homogeneous antibodies, i.e., the individual antibodies comprising the population are identical except for possible naturally occurring mutations that can be present in minor amounts. Monoclonal antibodies provided herein can be made by the hybridoma method, phage display technology, single lymphocyte gene cloning technology, or by recombinant DNA methods. For example, the monoclonal antibodies can be produced by a hybridoma which includes a B cell obtained from a transgenic nonhuman animal, such as a transgenic mouse or rat, having a genome comprising a human heavy chain transgene and a light chain transgene.

As used herein, the term "antigen-binding fragment" refers to an antibody fragment such as, for example, a diabody, a Fab, a Fab', a F(ab')2, an Fv fragment, a disulfide stabilized Fv fragment (dsFv), a (dsFv)$_2$, a bispecific dsFv (dsFv-dsFv'), a disulfide stabilized diabody (ds diabody), a single-chain antibody molecule (scFv), a single domain antibody (sdAb) an scFv dimer (bivalent diabody), a multispecific antibody formed from a portion of an antibody comprising one or more CDRs, a camelized single domain antibody, a nanobody, a domain antibody, a bivalent domain antibody, or any other antibody fragment that binds to an antigen but does not comprise a complete antibody structure. An antigen-binding fragment is capable of binding to the same antigen to which the parent antibody or a parent antibody fragment binds. According to particular embodiments, the antigen-binding fragment comprises a light chain variable region, a light chain constant region, and an Fd segment of the heavy chain. According to other particular embodiments, the antigen-binding fragment comprises Fab and F(ab').

As used herein, the term "single-chain antibody" refers to a conventional single-chain antibody in the field, which comprises a heavy chain variable region and a light chain variable region connected by a short peptide of about 15 to about 20 amino acids. As used herein, the term "single domain antibody" refers to a conventional single domain antibody in the field, which comprises a heavy chain variable region and a heavy chain constant region or which comprises only a heavy chain variable region.

As used herein, the term "human antibody" refers to an antibody produced by a human or an antibody having an amino acid sequence corresponding to an antibody produced by a human made using any technique known in the art. This definition of a human antibody includes intact or full-length antibodies, fragments thereof, and/or antibodies comprising at least one human heavy and/or light chain polypeptide.

As used herein, the term "humanized antibody" refers to a non-human antibody that is modified to increase the sequence homology to that of a human antibody, such that the antigen-binding properties of the antibody are retained, but its antigenicity in the human body is reduced.

As used herein, the term "chimeric antibody" refers to an antibody wherein the amino acid sequence of the immunoglobulin molecule is derived from two or more species. The variable region of both the light and heavy chains often corresponds to the variable region of an antibody derived from one species of mammal (e.g., mouse, rat, rabbit, etc.) having the desired specificity, affinity, and capability, while the constant regions correspond to the sequences of an antibody derived from another species of mammal (e.g., human) to avoid eliciting an immune response in that species.

As used herein, the term "multispecific antibody" refers to an antibody that comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, the first and second epitopes do not overlap or do not substantially overlap. In an embodiment, the first and second epitopes are on different antigens, e.g., the different proteins (or different subunits of a multimeric protein). In an embodiment, a multispecific antibody comprises a third, fourth, or fifth immunoglobulin variable domain. In an embodiment, a multispecific antibody is a bispecific antibody molecule, a trispecific antibody molecule, or a tetraspecific antibody molecule.

As used herein, the term "bispecific antibody" refers to a multispecific antibody that binds no more than two epitopes or two antigens. A bispecific antibody is characterized by a first immunoglobulin variable domain sequence which has binding specificity for a first epitope (e.g., an epitope on a TRGV9 antigen, an epitope on a TRDV2 antigen, or an epitope on TRGDC) and a second immunoglobulin variable domain sequence that has binding specificity for a second epitope. In an embodiment, the first and second epitopes are on different antigens, e.g., the different proteins (or different subunits of a multimeric protein). In an embodiment, a bispecific antibody comprises a heavy chain variable domain sequence and a light chain variable domain sequence which have binding specificity for a first epitope and a heavy chain variable domain sequence and a light chain variable domain sequence which have binding specificity for a second epitope. In an embodiment, a bispecific antibody comprises a half antibody, or fragment thereof, having binding specificity for a first epitope and a half antibody, or fragment thereof, having binding specificity for a second epitope. In an embodiment, a bispecific antibody comprises a scFv, or fragment thereof, having binding specificity for a first epitope, and a scFv, or fragment thereof, having binding specificity for a second epitope. A "trispecific antibody" is a multispecific antibody that binds three distinct antigens, or three distinct epitopes within the same antigen. A "quadraspecific antibody" is a multispecific antibody that binds four distinct antigens, or four distinct epitopes within the same antigen.

As used herein, the term "TRGV9" refers to a polypeptide capable of forming a T cell receptor when expressed on the surface of γδ T cells. TRGV9-expressing γδ T cells are among the first T cells to develop in the human fetus and are the predominant γδ T cell subset in healthy adult peripheral blood cells. The terms "TRGV9," "Vγ9," and "VG9" are used interchangeably herein. The term "TRGV9" includes any TRGV9 variant, isoform, and species homolog, which is naturally expressed by cells (including T cells) or can be expressed on cells transfected with genes or cDNA encoding the polypeptide. In specific embodiments, the TRGV9 is a human TRGV9. An exemplary human TRGV9 amino acid sequence is provided by GenBank Accession Number NG_001336.2.

As used herein, an antibody that "specifically binds to TRGV9" refers to an antibody that binds to a TRGV9, preferably a human TRGV9, with a KD of $1\times10^{-7}$M or less, such as $1\times10^{-8}$ M or less, $5\times10^{-9}$ M or less, $1\times10^{-9}$M or less, $5\times10^{-10}$ M or less, or $1\times10^{-10}$ or less.

As used herein, the term "TRDV2" refers to a polypeptide capable of forming a T cell receptor when expressed on the surface of γδ T cells. TRDV2-expressing γδ T cells are among the first T cells to develop in the human fetus and are the predominant γδ T cell subset in healthy adult peripheral blood cells. The terms "TRDV2," "Vδ2," and "VD2" are used interchangeably herein. The term "TRDV2" includes any TRDV2 variant, isoform, and species homolog, which is naturally expressed by cells (including T cells) or can be expressed on cells transfected with genes or cDNA encoding the polypeptide. In specific embodiments, the TRDV2 is a human TRDV2. An exemplary human TRDV2 amino acid sequence is provided by GenBank Accession Number NG_001332.3.

As used herein, an antibody that "specifically binds to TRDV2" refers to an antibody that binds to a TRDV2, such as a human TRDV2, with a KD of $1\times10^{-7}$ M or less, such as $1\times10^{-8}$ M or less, $5\times10^{-9}$ M or less, $1\times10^{-9}$ M or less, $5\times10^{-10}$ M or less, or $1\times10^{-10}$ M or less.

As used herein, the term the "TRGDC" refers to a polypeptide capable of forming a T cell receptor when expressed on the surface of γδ T cells. The terms "TRGDC" and "gamma delta constant" are used interchangeably herein. The term "TRGDC" includes any TRGDC variant, isoform, and species homolog, which is naturally expressed by cells (including T cells) or can be expressed on cells transfected with genes or cDNA encoding the polypeptide. In specific embodiments, the TRGDC is a human TRGDC. An exemplary human T cell receptor delta constant (TRDC) amino acid sequence is provided by GenBank Accession Number NG_001332.3, and an exemplary human T cell receptor gamma constant (TRGC) amino acid sequence is provided by GenBank Accession Number NC_000007.14 (TRGC1) or NC_000007.14 (TRGC2).

As used herein, an antibody that "specifically binds to TRGDC" refers to an antibody that binds to a TRGDC, such as a human TRGDC, with a KD of $1\times10^{-7}$ M or less, such as $1\times10^{-8}$ M or less, $5\times10^{-9}$ M or less, $1\times10^{-9}$ M or less, $5\times10^{-10}$ M or less, or $1\times10^{-10}$ M or less.

The term "KD" refers to the dissociation constant, which is obtained from the ratio of Kd to Ka (i.e., Kd/Ka) and is expressed as a molar concentration (M). KD values for antibodies can be determined using methods in the art in view of the present disclosure. For example, the KD of an antibody can be determined by using surface plasmon resonance, such as by using a biosensor system, e.g., a Biacore® system, or by using bio-layer interferometry technology, such as an Octet RED96 system. The smaller the value of the KD of an antibody, the higher affinity that the antibody binds to a target antigen.

In one aspect, provided herein is an antibody that binds to TRGV9. In some embodiments, provided herein is an antibody that binds to a TRGV9 antigen. In some embodiments, provided herein is an antibody that binds to a TRGV9 epitope.

In some embodiments, the antibody comprises a heavy chain variable region and a light chain variable region. In a some embodiments, the TRGV9 antibody is not a single domain antibody or nanobody. In some embodiments, the TRGV9 antibody is a humanized antibody. In some embodiments, the TRGV9 antibody is a fully human antibody.

In certain embodiments, provided herein is a TRGV9 antibody comprising a VH region, VL region, VH CDR1, VH CDR2, VH CDR3, VL CDR1, VL CDR2, and/or VL CDR3 of any one of the antibodies described herein. In some embodiments, provided herein is a TRGV9 antibody comprising a VH region of any one of the antibodies described herein. In some embodiments, provided herein is a TRGV9 antibody comprising a VL region of any one of the antibodies described herein. In some embodiments, provided herein is a TRGV9 antibody comprising a VH region of any one of the antibodies described herein, and a VL region of any one of the antibodies described herein. In some embodiments, provided herein is a TRGV9 antibody comprising a VH CDR1, VH CDR2, and VH CDR3 of any one of the antibodies described herein. In some embodiments, provided herein is a TRGV9 antibody comprising a VL CDR1, VL CDR2, and VL CDR3 of any one of the antibodies described herein. In some embodiments, provided herein is a TRGV9 antibody comprising a VH CDR1, VH CDR2, and VH CDR3 of any one of the antibodies described herein; and a VL CDR1, VL CDR2, and VL CDR3 of any one of the antibodies described herein. Representative VH and VL amino acid sequences, including VH CDR1, VH CDR2, VH CDR3, VL CDR1, VL CDR2 and VL CDR3 amino acid sequences, of TRGV9 antibodies provided herein are provided in the Tables 2-7.

In one aspect, provided herein is an antibody that binds to TRDV2. In some embodiments, provided herein is an antibody that binds to a TRDV2 antigen. In some embodiments, provided herein is an antibody that binds to a TRDV2 epitope.

In some embodiments, the antibody comprises a heavy chain variable region and a light chain variable region. In a some embodiments, the TRDV2 antibody is not a single domain antibody or nanobody. In some embodiments, the TRDV2 antibody is a humanized antibody. In some embodiments, the TRDV2 antibody is a fully human antibody.

In certain embodiments, provided herein is a TRDV2 antibody comprising a VH region, VL region, VH CDR1, VH CDR2, VH CDR3, VL CDR1, VL CDR2, and/or VL CDR3 of any one of the antibodies described herein. In some embodiments, provided herein is a TRDV2 antibody comprising a VH region of any one of the antibodies described herein. In some embodiments, provided herein is a TRDV2 antibody comprising a VL region of any one of the antibodies described herein. In some embodiments, provided herein is a TRDV2 antibody comprising a VH region of any one of the antibodies described herein, and a VL region of any one of the antibodies described herein. In some embodiments, provided herein is a TRDV2 antibody comprising a VH CDR1, VH CDR2, and VH CDR3 of any one of the antibodies described herein. In some embodiments, provided herein is a TRDV2 antibody comprising a VL CDR1, VL CDR2, and VL CDR3 of any one of the antibodies described herein. In some embodiments, provided herein is a TRDV2 antibody comprising a VH CDR1, VH CDR2, and VH CDR3 of any one of the antibodies described herein; and a VL CDR1, VL CDR2, and VL CDR3 of any one of the antibodies described herein. Representative VH and VL amino acid sequences, including VH CDR1, VH CDR2, VH CDR3, VL CDR1, VL CDR2 and VL CDR3 amino acid sequences, of TRDV2 antibodies provided herein are provided in Tables 2-7.

In one aspect, provided herein is an antibody that binds to TRGDC. In some embodiments, provided herein is an antibody that binds to a TRGDC antigen. In some embodiments, provided herein is an antibody that binds to a TRGDC epitope.

In some embodiments, the antibody comprises a heavy chain variable region and a light chain variable region. In a some embodiments, the TRGDC antibody is not a single domain antibody or nanobody. In some embodiments, the TRGDC antibody is a humanized antibody. In some embodiments, the TRGDC antibody is a fully human antibody.

In certain embodiments, provided herein is a TRGDC antibody comprising a VH region, VL region, VH CDR1, VH CDR2, VH CDR3, VL CDR1, VL CDR2, and/or VL CDR3 of any one of the antibodies described herein. In some embodiments, provided herein is a TRGDC antibody comprising a VH region of any one of the antibodies described herein. In some embodiments, provided herein is a TRGDC antibody comprising a VL region of any one of the antibodies described herein. In some embodiments, provided herein is a TRGDC antibody comprising a VH region of any one of the antibodies described herein, and a VL region of any one of the antibodies described herein. In some embodiments, provided herein is a TRGDC antibody comprising a VH CDR1, VH CDR2, and VH CDR3 of any one of the antibodies described herein. In some embodiments, provided herein is a TRGDC antibody comprising a VL CDR1, VL CDR2, and VL CDR3 of any one of the antibodies described herein. In some embodiments, provided herein is a TRGDC antibody comprising a VH CDR1, VH CDR2, and VH CDR3 of any one of the antibodies described herein; and a VL CDR1, VL CDR2, and VL CDR3 of any one of the antibodies described herein. Representative VH and VL amino acid sequences, including VH CDR1, VH CDR2, VH CDR3, VL CDR1, VL CDR2 and VL CDR3 amino acid sequences, of TRGDC antibodies provided herein are provided in Tables 2-7.

In some embodiments, the antibody specifically binds TRGV9. In other embodiments, the TRGV9 is present on the surface of a T cell. In some embodiments, the antibody specifically binds TRDV2. In other embodiments, the TRDV2 is present on the surface of a T cell. In some embodiments, the antibody specifically binds TRGDC. In other embodiments, the TRGDC is present on the surface of a T cell.

In some embodiments, the antibody is a humanized antibody. In certain embodiments, the antibody is an IgG antibody. In other embodiments, the IgG antibody is an IgG1, IgG2, IgG3, or IgG4 antibody. In some embodiments, the antibody is a bispecific antibody. In some embodiments, the antibody is a trispecific antibody. In some embodiments, the antibody is a quadraspecific antibody. In certain embodiments, the antibody is multivalent. In other embodiments, the antibody is capable of binding at least three antigens. In some embodiments, the antibody is capable of binding at least four antigens. In some embodiments, the antibody is capable of binding at least five antigens.

In certain embodiments, provided is a TRGV9 antibody that is an intact antibody. In other embodiments, provided is a TRGV9 antibody is an antigen binding fragment of the TRGV9 antibody. In some embodiments, the antigen binding fragment of the TRGV9 antibody is a functional fragment. In certain embodiments, provided is a TRDV2 antibody that is an intact antibody. In other embodiments, provided is a TRDV2 antibody is an antigen binding fragment of the TRDV2 antibody. In some embodiments, the antigen binding fragment of the TRDV2 antibody is a functional fragment. In certain embodiments, provided is a TRGDC antibody that is an intact antibody. In other embodiments, provided is a TRGDC antibody is an antigen binding fragment of the TRGDC antibody. In some embodiments, the antigen binding fragment of the TRGDC antibody is a functional fragment.

In some embodiments, the antigen binding fragment is a diabody. In some embodiments, the antigen binding fragment is a Fab. In some embodiments, the antigen binding fragment is a Fab'. In some embodiments, the antigen binding fragment is a F(ab')2. In some embodiments, the antigen binding fragment is a Fv fragment. In some embodiments, the antigen binding fragment is a disulfide stabilized Fv fragment (dsFv). In some embodiments, the antigen binding fragment is a (dsFv)$_2$. In some embodiments, the antigen binding fragment is a bispecific dsFv (dsFv-dsFv'). In some embodiments, the antigen binding fragment is a disulfide stabilized diabody (ds diabody). In some embodiments, the antigen binding fragment is a single-chain antibody molecule (scFv). In some embodiments, the antigen binding fragment is a single domain antibody (sdAb). In some embodiments, the antigen binding fragment is an scFv dimer (bivalent diabody). In some embodiments, the antigen binding fragment is a multispecific antibody formed from a portion of an antibody comprising one or more CDRs. In some embodiments, the antigen binding fragment is a camelized single domain antibody. In some embodiments, the antigen binding fragment is a nanobody. In some embodiments, the antigen binding fragment is a domain antibody. In some embodiments, the antigen binding fragment is a bivalent domain antibody. In some embodiments, the antigen binding fragment is an antibody fragment that binds to an antigen but does not comprise a complete antibody structure.

In specific embodiments, the TRGV9 antibody comprises a VH region and a VL region. In some embodiments, the TRGV9 antibody is a single chain antibody. In some embodiments, the TRGV9 antibody is a single domain antibody. In some embodiments, the TRGV9 antibody is a nanobody. In certain embodiments, the TRGV9 antibody is a VHH antibody. In certain embodiments, the TRGV9 antibody is a llama antibody. In some embodiments, the TRGV9 antibody is not a single chain antibody. In some embodiments, the TRGV9 antibody is not a single domain antibody. In some embodiments, the TRGV9 antibody is not a nanobody. In certain embodiments, the TRGV9 antibody is not a VHH antibody. In certain embodiments, the TRGV9 antibody is not a llama antibody. In some embodiments, the TRGV9 antibody is a multispecific antibody In other embodiments, the TRGV9 antibody is a bispecific antibody. In other embodiments, the TRGV9 antibody is a trispecific antibody. In other embodiments, the TRGV9 antibody is a quadraspecific antibody. In certain embodiments, the multispecific antibody comprises an antigen binding fragment of a TRGV9 antibody provided herein. In other embodiments, the bispecific antibody comprises an antigen binding fragment of a TRGV9 antibody provided herein. In other embodiments, the trispecific antibody comprises an antigen binding fragment of a TRGV9 antibody provided herein. In other embodiments, the quadraspecific antibody comprises an antigen binding fragment of a TRGV9 antibody provided herein. In certain embodiments, the TRGV9 antibody activates T cells. In other embodiments, the TRGV9 antibody is an antagonistic antibody. In certain embodiments, the TRGV9 antibody inactivates T cells. In some embodiments, the TRGV9 antibody blocks activation of T cells. In some embodiments, the TRGV9 antibody modulates the activity of T cells. In some embodiments, the TRGV9 antibody neither activates or inactivates the activity of T cells. In specific embodiments, the T cells are human T cells.

In specific embodiments, the TRDV2 antibody comprises a VH region and a VL region. In some embodiments, the TRDV2 antibody is a single chain antibody. In some embodiments, the TRDV2 antibody is a single domain antibody. In some embodiments, the TRDV2 antibody is a nanobody. In certain embodiments, the TRDV2 antibody is a VHH antibody. In certain embodiments, the TRDV2 antibody is a llama antibody. In some embodiments, the TRDV2 antibody is not a single chain antibody. In some embodiments, the TRDV2 antibody is not a single domain antibody. In some embodiments, the TRDV2 antibody is not a nanobody. In certain embodiments, the TRDV2 antibody is not a VHH antibody. In certain embodiments, the TRDV2 antibody is not a llama antibody. In some embodiments, the TRDV2 antibody is a multispecific antibody In other embodiments, the TRDV2 antibody is a bispecific antibody. In other embodiments, the TRDV2 antibody is a trispecific antibody. In other embodiments, the TRDV2 antibody is a quadraspecific antibody. In certain embodiments, the multispecific antibody comprises an antigen binding fragment of a TRDV2 antibody provided herein. In other embodiments, the bispecific antibody comprises an antigen binding fragment of a TRDV2 antibody provided herein. In other embodiments, the trispecific antibody comprises an antigen binding fragment of a TRDV2 antibody provided herein. In other embodiments, the quadraspecific antibody comprises an antigen binding fragment of a TRDV2 antibody provided herein. In certain embodiments, the TRDV2 antibody activates T cells. In other embodiments, the TRDV2 antibody is an antagonistic antibody. In certain embodiments, the TRDV2 antibody inactivates T cells. In some embodiments, the TRDV2 antibody blocks activation of T cells. In some embodiments, the TRDV2 antibody modulates the activity of T cells. In some embodiments, the TRDV2 antibody neither activates or inactivates the activity of T cells. In specific embodiments, the T cells are human T cells.

In specific embodiments, the TRGDC antibody comprises a VH region and a VL region. In some embodiments, the TRGDC antibody is a single chain antibody. In some embodiments, the TRGDC antibody is a single domain antibody. In some embodiments, the TRGDC antibody is a nanobody. In certain embodiments, the TRGDC antibody is a VHH antibody. In certain embodiments, the TRGDC antibody is a llama antibody. In some embodiments, the TRGDC antibody is not a single chain antibody. In some embodiments, the TRGDC antibody is not a single domain antibody. In some embodiments, the TRGDC antibody is not a nanobody. In certain embodiments, the TRGDC antibody is not a VHH antibody. In certain embodiments, the TRGDC antibody is not a llama antibody. In some embodiments, the TRGDC antibody is a multispecific antibody In other embodiments, the TRGDC antibody is a bispecific antibody. In other embodiments, the TRGDC antibody is a trispecific antibody. In other embodiments, the TRGDC antibody is a quadraspecific antibody. In certain embodiments, the multispecific antibody comprises an antigen binding fragment of a TRGDC antibody provided herein. In other embodiments, the bispecific antibody comprises an antigen binding fragment of a TRGDC antibody provided herein. In other embodiments, the trispecific antibody comprises an antigen binding fragment of a TRGDC antibody provided herein. In other embodiments, the quadraspecific antibody comprises an antigen binding fragment of a TRGDC antibody provided herein. In certain embodiments, the TRGDC antibody activates T cells. In other embodiments, the TRGDC antibody is an antagonistic antibody. In certain embodiments, the TRGDC antibody inactivates T cells. In some embodiments, the TRGDC antibody blocks activation of T cells. In some embodiments, the TRGDC antibody modulates the activity of T cells. In some embodiments, the TRGDC antibody neither activates or inactivates the activity of T cells. In specific embodiments, the T cells are human T cells.

In some embodiments, the VH CDR1, VH CDR2, VH CDR3, VL CDR1, VL CDR2, and VL CDR3 sequences are according to the Kabat numbering system. In some embodiments, the VH CDR1, VH CDR2, VH CDR3, VL CDR1, VL CDR2, and VL CDR3 sequences are according to the Chothia numbering system. In some embodiments, the VH CDR1, VH CDR2, VH CDR3, VL CDR1, VL CDR2, and VL CDR3 sequences are according to the Exemplary numbering system. In some embodiments, the VH CDR1, VH CDR2, VH CDR3, VL CDR1, VL CDR2, and VL CDR3 sequences are according to the Contact numbering system. In some embodiments, the VH CDR1, VH CDR2, VH CDR3, VL CDR1, VL CDR2, and VL CDR3 sequences are according to the IMGT numbering system. In some embodiments, the VH CDR1, VH CDR2, VH CDR3, VL CDR1, VL CDR2, and VL CDR3 sequences are according to the AbM numbering system. Exemplary sets of 6 CDRs (VH CDR1-3 and VL CDR1-3) of certain antibody embodiments are provided herein. Other sets of CDRs are contemplated and within the scope of the antibody embodiments provided herein.

In one aspect, provided herein is an antibody that binds to TRGV9. In some embodiments, the antibody comprises a heavy chain variable region and a light chain variable region. In some embodiments, the TRGV9 antibody is a humanized antibody.

In one aspect, provided herein is an antibody that binds TRGV9, comprising: (i) a VH comprising a VH CDR1, a VH CDR2, and a VH CDR3 having an amino acid sequence of SEQ ID NOs:1, 2, and 3, respectively, and (ii) a VL comprising a VL CDR1, VL CDR2, and VL CDR3 having an amino acid sequence of SEQ ID NOs:4, 5, and 6, respectively. In one aspect, provided herein is an antibody that binds TRGV9, comprising: (i) a VH comprising a VH CDR1, a VH CDR2, and a VH CDR3 having an amino acid sequence of SEQ ID NOs:7, 8, and 9, respectively, and (ii) a VL comprising a VL CDR1, VL CDR2, and VL CDR3 having an amino acid sequence of SEQ ID NOs:10, 11, and 12, respectively. In one aspect, provided herein is an antibody that binds TRGV9, comprising: (i) a VH comprising a VH CDR1, a VH CDR2, and a VH CDR3 having an amino acid sequence of SEQ ID NOs:13, 14, and 15, respectively, and (ii) a VL comprising a VL CDR1, VL CDR2, and VL CDR3 having an amino acid sequence of SEQ ID NOs:16, 17, and 18, respectively. In one aspect, provided herein is an antibody that binds TRGV9, comprising: (i) a VH comprising a VH CDR1, a VH CDR2, and a VH CDR3 having an amino acid sequence of SEQ ID NOs:19, 20, and 21, respectively, and (ii) a VL comprising a VL CDR1, VL CDR2, and VL CDR3 having an amino acid sequence of SEQ ID NOs:22, 23, and 24, respectively. In one aspect, provided herein is an antibody that binds TRGV9, comprising: (i) a VH comprising a VH CDR1, a VH CDR2, and a VH CDR3 having an amino acid sequence of SEQ ID NOs:25, 26, and 27, respectively, and (ii) a VL comprising a VL CDR1, VL CDR2, and VL CDR3 having an amino acid sequence of SEQ ID NOs:28, 29, and 30, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and (ii) a VL comprising a VL CDR1, a VL CDR2, and a VL CDR3 having an amino acid sequence of a VL CDR1, a VL CDR2, and a VL CDR3, respectively, of SEQ ID NO:32. In one aspect, provided herein is an antibody that binds TRGV9, comprising a VH having an amino acid sequence of SEQ ID NO:31. In one aspect, provided herein is an antibody that binds TRGV9, comprising a VL having an amino acid sequence of SEQ ID NO:32. In one aspect, provided herein is an antibody that binds TRGV9, comprising a VH having an amino acid sequence of SEQ ID NO:31, and a VL having an amino acid sequence of SEQ ID NO:32. In one aspect, provided herein is an antibody that binds TRGV9, comprising a heavy chain having an amino acid sequence of SEQ ID NO:33. In one aspect, provided herein is an antibody that binds TRGV9, comprising a light chain having an amino acid sequence of SEQ ID NO:34. In one aspect, provided herein is an antibody that binds TRGV9, comprising a heavy chain having an amino acid sequence of SEQ ID NO:33, and a light chain having an amino acid sequence of SEQ ID NO:34. In one aspect, provided herein is an antibody that binds TRGV9, comprising a VH having an amino acid sequence having at least 95% identity to an amino acid sequence of SEQ ID NO:31. In one aspect, provided herein is an antibody that binds TRGV9, comprising a VL having an amino acid sequence having at least 95% identity to an amino acid sequence of SEQ ID NO:32. In one aspect, provided herein is an antibody that binds TRGV9, comprising a VH having an amino acid sequence having at least 95% identity to an amino acid sequence of SEQ ID NO:31, and a VL having an amino acid sequence having at least 95% identity to an amino acid sequence of SEQ ID NO:32. In one aspect, provided herein is an antibody that binds TRGV9, comprising a heavy chain having an amino acid sequence having at least 95% identity to an amino acid sequence of SEQ ID NO:33. In one aspect, provided herein is an antibody that binds TRGV9, comprising a light chain having an amino acid sequence having at least 95% identity to an amino acid sequence of SEQ ID NO:34. In one aspect, provided herein is an antibody that binds TRGV9, comprising a heavy chain having an amino acid sequence having at least 95% identity to an amino acid sequence of SEQ ID NO:33, and a light chain having an amino acid sequence having at least 95% identity to an amino acid sequence of SEQ ID NO:34.

In one aspect, provided herein is an antibody that binds TRGV9, comprising: (i) a VH comprising a VH CDR1, a VH CDR2, and a VH CDR3 having an amino acid sequence of SEQ ID NOs:35, 36, and 37, respectively, and (ii) a VL comprising a VL CDR1, VL CDR2, and VL CDR3 having an amino acid sequence of SEQ ID NOs:38, 39, and 40, respectively. In one aspect, provided herein is an antibody that binds TRGV9, comprising: (i) a VH comprising a VH CDR1, a VH CDR2, and a VH CDR3 having an amino acid sequence of SEQ ID NOs:41, 42, and 43, respectively, and (ii) a VL comprising a VL CDR1, VL CDR2, and VL CDR3 having an amino acid sequence of SEQ ID NOs:44, 45, and 46, respectively. In one aspect, provided herein is an antibody that binds TRGV9, comprising: (i) a VH comprising a VH CDR1, a VH CDR2, and a VH CDR3 having an amino acid sequence of SEQ ID NOs:47, 48, and 49, respectively, and (ii) a VL comprising a VL CDR1, VL CDR2, and VL CDR3 having an amino acid sequence of SEQ ID NOs:50, 51, and 52, respectively. In one aspect, provided herein is an antibody that binds TRGV9, comprising: (i) a VH comprising a VH CDR1, a VH CDR2, and a VH CDR3 having an amino acid sequence of SEQ ID NOs:53, 54, and 55, respectively, and (ii) a VL comprising a VL CDR1, VL CDR2, and VL CDR3 having an amino acid sequence of SEQ ID NOs:56, 57, and 58, respectively. In one aspect, provided herein is an antibody that binds TRGV9, comprising: (i) a VH comprising a VH CDR1, a VH CDR2, and a VH CDR3 having an amino acid sequence of SEQ ID NOs:59, 60, and 61, respectively, and (ii) a VL comprising a VL CDR1, VL CDR2, and VL CDR3 having an amino acid sequence of SEQ ID NOs:62, 63, and 64, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and (ii) a VL comprising a VL CDR1, a VL CDR2, and a VL CDR3 having an amino acid sequence of a VL CDR1, a VL CDR2, and a VL CDR3, respectively, of SEQ ID NO:66. In one aspect, provided herein is an antibody that binds TRGV9, comprising a VH having an amino acid sequence of SEQ ID NO:65. In one aspect, provided herein is an antibody that binds TRGV9, comprising a VL having an amino acid sequence of SEQ ID NO:66. In one aspect, provided herein is an antibody that binds TRGV9, comprising a VH having an amino acid sequence of SEQ ID NO:65, and a VL having an amino acid sequence of SEQ ID NO:66. In one aspect, provided herein is an antibody that binds TRGV9, comprising a heavy chain having an amino acid sequence of SEQ ID NO:67. In one aspect, provided herein is an antibody that binds TRGV9, comprising a light chain having an amino acid sequence of SEQ ID NO:68. In one aspect, provided herein is an antibody that binds TRGV9, comprising a heavy chain having an amino acid sequence of SEQ ID NO:67, and a light chain having an amino acid sequence of SEQ ID NO:68. In one aspect, provided herein is an antibody that binds TRGV9, comprising a VH having an amino acid sequence having at least 95% identity to an amino acid sequence of SEQ ID NO:65. In one aspect, provided herein is an antibody that binds TRGV9, comprising a VL having an amino acid sequence having at least 95% identity to an amino acid sequence of SEQ ID NO:66. In one aspect, provided herein is an antibody that binds TRGV9, comprising a VH having an amino acid sequence having at least 95% identity to an amino acid sequence of SEQ ID NO:65, and a VL having an amino acid sequence having at least 95% identity to an amino acid sequence of SEQ ID NO:66. In one aspect, provided herein is an antibody that binds TRGV9, comprising a heavy chain having an amino acid sequence having at least 95% identity to an amino acid sequence of SEQ ID NO:67. In one aspect, provided herein is an antibody that binds TRGV9, comprising a light chain having an amino acid sequence having at least 95% identity to an amino acid sequence of SEQ ID NO:68. In one aspect, provided herein is an antibody that binds TRGV9, comprising a heavy chain having an amino acid sequence having at least 95% identity to an amino acid sequence of SEQ ID NO:67, and a light chain having an amino acid sequence having at least 95% identity to an amino acid sequence of SEQ ID NO:68.

In one aspect, provided herein is an antibody that binds TRGV9, comprising: (i) a VH comprising a VH CDR1, a VH CDR2, and a VH CDR3 having an amino acid sequence of SEQ ID NOs:69, 70, and 71, respectively, and (ii) a VL comprising a VL CDR1, VL CDR2, and VL CDR3 having an amino acid sequence of SEQ ID NOs:72, 73, and 74, respectively. In one aspect, provided herein is an antibody that binds TRGV9, comprising: (i) a VH comprising a VH CDR1, a VH CDR2, and a VH CDR3 having an amino acid sequence of SEQ ID NOs:75, 76, and 77, respectively, and (ii) a VL comprising a VL CDR1, VL CDR2, and VL CDR3 having an amino acid sequence of SEQ ID NOs:78, 79, and 80, respectively. In one aspect, provided herein is an antibody that binds TRGV9, comprising: (i) a VH comprising a VH CDR1, a VH CDR2, and a VH CDR3 having an amino acid sequence of SEQ ID NOs:81, 82, and 83, respectively, and (ii) a VL comprising a VL CDR1, VL CDR2, and VL CDR3 having an amino acid sequence of SEQ ID NOs:84, 85, and 86, respectively. In one aspect, provided herein is an antibody that binds TRGV9, comprising: (i) a VH comprising a VH CDR1, a VH CDR2, and a VH CDR3 having an amino acid sequence of SEQ ID NOs:87, 88, and 89, respectively, and (ii) a VL comprising a VL CDR1, VL CDR2, and VL CDR3 having an amino acid sequence of SEQ ID NOs:90, 91, and 92, respectively. In one aspect, provided herein is an antibody that binds TRGV9, comprising: (i) a VH comprising a VH CDR1, a VH CDR2, and a VH CDR3 having an amino acid sequence of SEQ ID NOs:93, 94, and 95, respectively, and (ii) a VL comprising a VL CDR1, VL CDR2, and VL CDR3 having an amino acid sequence of SEQ ID NOs:96, 97, and 98, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and (ii) a VL comprising a VL CDR1, a VL CDR2, and a VL CDR3 having an amino acid sequence of a VL CDR1, a VL CDR2, and a VL CDR3, respectively, of SEQ ID NO:100. In one aspect, provided herein is an antibody that binds TRGV9, comprising a VH having an amino acid sequence of SEQ ID NO:99. In one aspect, provided herein is an antibody that binds TRGV9, comprising a VL having an amino acid sequence of SEQ ID NO:100. In one aspect, provided herein is an antibody that binds TRGV9, comprising a VH having an amino acid sequence of SEQ ID NO:99, and a VL having an amino acid sequence of SEQ ID NO:100. In one aspect, provided herein is an antibody that binds TRGV9, comprising a heavy chain having an amino acid sequence of SEQ ID NO:101. In one aspect, provided herein is an antibody that binds TRGV9, comprising a light chain having an amino acid sequence of SEQ ID NO:102. In one aspect, provided herein is an antibody that binds TRGV9, comprising a heavy chain having an amino acid sequence of SEQ ID NO:101, and a light chain having an amino acid sequence of SEQ ID NO:102. In one aspect, provided herein is an antibody that binds TRGV9, comprising a VH having an amino acid sequence having at least 95% identity to an amino acid sequence of SEQ ID NO:99. In one aspect, provided herein is an antibody that binds TRGV9, comprising a VL having an amino acid sequence having at least 95% identity to an amino acid sequence of SEQ ID NO:100. In one aspect, provided herein is an antibody that binds TRGV9, comprising a VH having an amino acid sequence having at least 95% identity to an amino acid sequence of SEQ ID NO:99, and a VL having an amino acid sequence having at least 95% identity to an amino acid sequence of SEQ ID NO:100. In one aspect, provided herein is an antibody that binds TRGV9, comprising a heavy chain having an amino acid sequence having at least 95% identity to an amino acid sequence of SEQ ID NO:101. In one aspect, provided herein is an antibody that binds TRGV9, comprising a light chain having an amino acid sequence having at least 95% identity to an amino acid sequence of SEQ ID NO:102. In one aspect, provided herein is an antibody that binds TRGV9, comprising a heavy chain having an amino acid sequence having at least 95% identity to an amino acid sequence of SEQ ID NO:101, and a light chain having an amino acid sequence having at least 95% identity to an amino acid sequence of SEQ ID NO:102.

In one aspect, provided herein is an antibody that binds TRGV9, comprising: (i) a VH comprising a VH CDR1, a VH CDR2, and a VH CDR3 having an amino acid sequence of SEQ ID NOs:103, 104, and 105, respectively, and (ii) a VL comprising a VL CDR1, VL CDR2, and VL CDR3 having an amino acid sequence of SEQ ID NOs:106, 107, and 108, respectively. In one aspect, provided herein is an antibody that binds TRGV9, comprising: (i) a VH comprising a VH CDR1, a VH CDR2, and a VH CDR3 having an amino acid sequence of SEQ ID NOs:109, 110, and 111, respectively, and (ii) a VL comprising a VL CDR1, VL CDR2, and VL CDR3 having an amino acid sequence of SEQ ID NOs:112, 113, and 114, respectively. In one aspect, provided herein is an antibody that binds TRGV9, comprising: (i) a VH comprising a VH CDR1, a VH CDR2, and a VH CDR3 having an amino acid sequence of SEQ ID NOs:115, 116, and 117, respectively, and (ii) a VL comprising a VL CDR1, VL CDR2, and VL CDR3 having an amino acid sequence of SEQ ID NOs:118, 119, and 120, respectively. In one aspect, provided herein is an antibody that binds TRGV9, comprising: (i) a VH comprising a VH CDR1, a VH CDR2, and a VH CDR3 having an amino acid sequence of SEQ ID NOs:121, 122, and 123, respectively, and (ii) a VL comprising a VL CDR1, VL CDR2, and VL CDR3 having an amino acid sequence of SEQ ID NOs:124, 125, and 126, respectively. In one aspect, provided herein is an antibody that binds TRGV9, comprising: (i) a VH comprising a VH CDR1, a VH CDR2, and a VH CDR3 having an amino acid sequence of SEQ ID NOs:127, 128, and 129, respectively, and (ii) a VL comprising a VL CDR1, VL CDR2, and VL CDR3 having an amino acid sequence of SEQ ID NOs:130, 131, and 132, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and (ii) a VL comprising a VL CDR1, a VL CDR2, and a VL CDR3 having an amino acid sequence of a VL CDR1, a VL CDR2, and a VL CDR3, respectively, of SEQ ID NO:134. In one aspect, provided herein is an antibody that binds TRGV9, comprising a VH having an amino acid sequence of SEQ ID NO:133. In one aspect, provided herein is an antibody that binds TRGV9, comprising a VL having an amino acid sequence of SEQ ID NO:134. In one aspect, provided herein is an antibody that binds TRGV9, comprising a VH having an amino acid sequence of SEQ ID NO:133, and a VL having an amino acid sequence of SEQ ID NO:134. In one aspect, provided herein is an antibody that binds TRGV9, comprising a heavy chain having an amino acid sequence of SEQ ID NO:135. In one aspect, provided herein is an antibody that binds TRGV9, comprising a light chain having an amino acid sequence of SEQ ID NO:136. In one aspect, provided herein is an antibody that binds TRGV9, comprising a heavy chain having an amino acid sequence of SEQ ID NO:135, and a light chain having an amino acid sequence of SEQ ID NO:136. In one aspect, provided herein is an antibody that binds TRGV9, comprising a VH having an amino acid sequence having at least 95% identity to an amino acid sequence of SEQ ID NO:133. In one aspect, provided herein is an antibody that binds TRGV9, comprising a VL having an amino acid sequence having at least 95% identity to an amino acid sequence of SEQ ID NO:134. In one aspect, provided herein is an antibody that binds TRGV9, comprising a VH having an amino acid sequence having at least 95% identity to an amino acid sequence of SEQ ID NO:133, and a VL having an amino acid sequence having at least 95% identity to an amino acid sequence of SEQ ID NO:134. In one aspect, provided herein is an antibody that binds TRGV9, comprising a heavy chain having an amino acid sequence having at least 95% identity to an amino acid sequence of SEQ ID NO:135. In one aspect, provided herein is an antibody that binds TRGV9, comprising a light chain having an amino acid sequence having at least 95% identity to an amino acid sequence of SEQ ID NO:136. In one aspect, provided herein is an antibody that binds TRGV9, comprising a heavy chain having an amino acid sequence having at least 95% identity to an amino acid sequence of SEQ ID NO:135, and a light chain having an amino acid sequence having at least 95% identity to an amino acid sequence of SEQ ID NO:136.

In one aspect, provided herein is an antibody that binds TRGV9, comprising: (i) a VH comprising a VH CDR1, a VH CDR2, and a VH CDR3 having an amino acid sequence of SEQ ID NOs:137, 138, and 139, respectively, and (ii) a VL comprising a VL CDR1, VL CDR2, and VL CDR3 having an amino acid sequence of SEQ ID NOs:140, 141, and 142, respectively. In one aspect, provided herein is an antibody that binds TRGV9, comprising: (i) a VH comprising a VH CDR1, a VH CDR2, and a VH CDR3 having an amino acid sequence of SEQ ID NOs:143, 144, and 145, respectively, and (ii) a VL comprising a VL CDR1, VL CDR2, and VL CDR3 having an amino acid sequence of SEQ ID NOs:146, 147, and 148, respectively. In one aspect, provided herein is an antibody that binds TRGV9, comprising: (i) a VH comprising a VH CDR1, a VH CDR2, and a VH CDR3 having an amino acid sequence of SEQ ID NOs:149, 150, and 151, respectively, and (ii) a VL comprising a VL CDR1, VL CDR2, and VL CDR3 having an amino acid sequence of SEQ ID NOs:152, 153, and 154, respectively. In one aspect, provided herein is an antibody that binds TRGV9, comprising: (i) a VH comprising a VH CDR1, a VH CDR2, and a VH CDR3 having an amino acid sequence of SEQ ID NOs:155, 156, and 157, respectively, and (ii) a VL comprising a VL CDR1, VL CDR2, and VL CDR3 having an amino acid sequence of SEQ ID NOs:158, 159, and 160, respectively. In one aspect, provided herein is an antibody that binds TRGV9, comprising: (i) a VH comprising a VH CDR1, a VH CDR2, and a VH CDR3 having an amino acid sequence of SEQ ID NOs:161, 162, and 163, respectively, and (ii) a VL comprising a VL CDR1, VL CDR2, and VL CDR3 having an amino acid sequence of SEQ ID NOs:164, 165, and 166, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and (ii) a VL comprising a VL CDR1, a VL CDR2, and a VL CDR3 having an amino acid sequence of a VL CDR1, a VL CDR2, and a VL CDR3, respectively, of SEQ ID NO:168. In one aspect, provided herein is an antibody that binds TRGV9, comprising a VH having an amino acid sequence of SEQ ID NO:167. In one aspect, provided herein is an antibody that binds TRGV9, comprising a VL having an amino acid sequence of SEQ ID NO:168. In one aspect, provided herein is an antibody that binds TRGV9, comprising a VH having an amino acid sequence of SEQ ID NO:167, and a VL having an amino acid sequence of SEQ ID NO:168. In one aspect, provided herein is an antibody that binds TRGV9, comprising a heavy chain having an amino acid sequence of SEQ ID NO:169. In one aspect, provided herein is an antibody that binds TRGV9, comprising a light chain having an amino acid sequence of SEQ ID NO:170. In one aspect, provided herein is an antibody that binds TRGV9, comprising a heavy chain having an amino acid sequence of SEQ ID NO:169, and a light chain having an amino acid sequence of SEQ ID NO:170. In one aspect, provided herein is an antibody that binds TRGV9, comprising a VH having an amino acid sequence having at least 95% identity to an amino acid sequence of SEQ ID NO:167. In one aspect, provided herein is an antibody that binds TRGV9, comprising a VL having an amino acid sequence having at least 95% identity to an amino acid sequence of SEQ ID NO:168. In one aspect, provided herein is an antibody that binds TRGV9, comprising a VH having an amino acid sequence having at least 95% identity to an amino acid sequence of SEQ ID NO:167, and a VL having an amino acid sequence having at least 95% identity to an amino acid sequence of SEQ ID NO:168. In one aspect, provided herein is an antibody that binds TRGV9, comprising a heavy chain having an amino acid sequence having at least 95% identity to an amino acid sequence of SEQ ID NO:169. In one aspect, provided herein is an antibody that binds TRGV9, comprising a light chain having an amino acid sequence having at least 95% identity to an amino acid sequence of SEQ ID NO:170. In one aspect, provided herein is an antibody that binds TRGV9, comprising a heavy chain having an amino acid sequence having at least 95% identity to an amino acid sequence of SEQ ID NO:169, and a light chain having an amino acid sequence having at least 95% identity to an amino acid sequence of SEQ ID NO:170.

In one aspect, provided herein is an antibody that binds TRGV9, comprising: (i) a VH comprising a VH CDR1, a VH CDR2, and a VH CDR3 having an amino acid sequence of SEQ ID NOs:171, 172, and 173, respectively, and (ii) a VL comprising a VL CDR1, VL CDR2, and VL CDR3 having an amino acid sequence of SEQ ID NOs:174, 175, and 176, respectively. In one aspect, provided herein is an antibody that binds TRGV9, comprising: (i) a VH comprising a VH CDR1, a VH CDR2, and a VH CDR3 having an amino acid sequence of SEQ ID NOs:177, 178, and 179, respectively, and (ii) a VL comprising a VL CDR1, VL CDR2, and VL CDR3 having an amino acid sequence of SEQ ID NOs:180, 181, and 182, respectively. In one aspect, provided herein is an antibody that binds TRGV9, comprising: (i) a VH comprising a VH CDR1, a VH CDR2, and a VH CDR3 having an amino acid sequence of SEQ ID NOs:183, 184, and 185, respectively, and (ii) a VL comprising a VL CDR1, VL CDR2, and VL CDR3 having an amino acid sequence of SEQ ID NOs:186, 187, and 188, respectively. In one aspect, provided herein is an antibody that binds TRGV9, comprising: (i) a VH comprising a VH CDR1, a VH CDR2, and a VH CDR3 having an amino acid sequence of SEQ ID NOs:189, 190, and 191, respectively, and (ii) a VL comprising a VL CDR1, VL CDR2, and VL CDR3 having an amino acid sequence of SEQ ID NOs:192, 193, and 194, respectively. In one aspect, provided herein is an antibody that binds TRGV9, comprising: (i) a VH comprising a VH CDR1, a VH CDR2, and a VH CDR3 having an amino acid sequence of SEQ ID NOs:195, 196, and 197, respectively, and (ii) a VL comprising a VL CDR1, VL CDR2, and VL CDR3 having an amino acid sequence of SEQ ID NOs:198, 199, and 200, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and (ii) a VL comprising a VL CDR1, a VL CDR2, and a VL CDR3 having an amino acid sequence of a VL CDR1, a VL CDR2, and a VL CDR3, respectively, of SEQ ID NO:202. In one aspect, provided herein is an antibody that binds TRGV9, comprising a VH having an amino acid sequence of SEQ ID NO:201. In one aspect, provided herein is an antibody that binds TRGV9, comprising a VL having an amino acid sequence of SEQ ID NO:202. In one aspect, provided herein is an antibody that binds TRGV9, comprising a VH having an amino acid sequence of SEQ ID NO:201, and a VL having an amino acid sequence of SEQ ID NO:202. In one aspect, provided herein is an antibody that binds TRGV9, comprising a heavy chain having an amino acid sequence of SEQ ID NO:203. In one aspect, provided herein is an antibody that binds TRGV9, comprising a light chain having an amino acid sequence of SEQ ID NO:204. In one aspect, provided herein is an antibody that binds TRGV9, comprising a heavy chain having an amino acid sequence of SEQ ID NO:203, and a light chain having an amino acid sequence of SEQ ID NO:204. In one aspect, provided herein is an antibody that binds TRGV9, comprising a VH having an amino acid sequence having at least 95% identity to an amino acid sequence of SEQ ID NO:201. In one aspect, provided herein is an antibody that binds TRGV9, comprising a VL having an amino acid sequence having at least 95% identity to an amino acid sequence of SEQ ID NO:202. In one aspect, provided herein is an antibody that binds TRGV9, comprising a VH having an amino acid sequence having at least 95% identity to an amino acid sequence of SEQ ID NO:201, and a VL having an amino acid sequence having at least 95% identity to an amino acid sequence of SEQ ID NO:202. In one aspect, provided herein is an antibody that binds TRGV9, comprising a heavy chain having an amino acid sequence having at least 95% identity to an amino acid sequence of SEQ ID NO:203. In one aspect, provided herein is an antibody that binds TRGV9, comprising a light chain having an amino acid sequence having at least 95% identity to an amino acid sequence of SEQ ID NO:204. In one aspect, provided herein is an antibody that binds TRGV9, comprising a heavy chain having an amino acid sequence having at least 95% identity to an amino acid sequence of SEQ ID NO:203, and a light chain having an amino acid sequence having at least 95% identity to an amino acid sequence of SEQ ID NO:204.

In one aspect, provided herein is an antibody that binds TRGV9, comprising: (i) a VH comprising a VH CDR1, a VH CDR2, and a VH CDR3 having an amino acid sequence of SEQ ID NOs:205, 206, and 207, respectively, and (ii) a VL comprising a VL CDR1, VL CDR2, and VL CDR3 having an amino acid sequence of SEQ ID NOs:208, 209, and 210, respectively. In one aspect, provided herein is an antibody that binds TRGV9, comprising: (i) a VH comprising a VH CDR1, a VH CDR2, and a VH CDR3 having an amino acid sequence of SEQ ID NOs:211, 212, and 213, respectively, and (ii) a VL comprising a VL CDR1, VL CDR2, and VL CDR3 having an amino acid sequence of SEQ ID NOs:214, 215, and 216, respectively. In one aspect, provided herein is an antibody that binds TRGV9, comprising: (i) a VH comprising a VH CDR1, a VH CDR2, and a VH CDR3 having an amino acid sequence of SEQ ID NOs:217, 218, and 219, respectively, and (ii) a VL comprising a VL CDR1, VL CDR2, and VL CDR3 having an amino acid sequence of SEQ ID NOs:220, 221, and 222, respectively. In one aspect, provided herein is an antibody that binds TRGV9, comprising: (i) a VH comprising a VH CDR1, a VH CDR2, and a VH CDR3 having an amino acid sequence of SEQ ID NOs:223, 224, and 225, respectively, and (ii) a VL comprising a VL CDR1, VL CDR2, and VL CDR3 having an amino acid sequence of SEQ ID NOs:226, 227, and 228, respectively. In one aspect, provided herein is an antibody that binds TRGV9, comprising: (i) a VH comprising a VH CDR1, a VH CDR2, and a VH CDR3 having an amino acid sequence of SEQ ID NOs:229, 230, and 231, respectively, and (ii) a VL comprising a VL CDR1, VL CDR2, and VL CDR3 having an amino acid sequence of SEQ ID NOs:232, 233, and 234, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and (ii) a VL comprising a VL CDR1, a VL CDR2, and a VL CDR3 having an amino acid sequence of a VL CDR1, a VL CDR2, and a VL CDR3, respectively, of SEQ ID NO:236. In one aspect, provided herein is an antibody that binds TRGV9, comprising a VH having an amino acid sequence of SEQ ID NO:235. In one aspect, provided herein is an antibody that binds TRGV9, comprising a VL having an amino acid sequence of SEQ ID NO:236. In one aspect, provided herein is an antibody that binds TRGV9, comprising a VH having an amino acid sequence of SEQ ID NO:235, and a VL having an amino acid sequence of SEQ ID NO:236. In one aspect, provided herein is an antibody that binds TRGV9, comprising a heavy chain having an amino acid sequence of SEQ ID NO:237. In one aspect, provided herein is an antibody that binds TRGV9, comprising a light chain having an amino acid sequence of SEQ ID NO:238. In one aspect, provided herein is an antibody that binds TRGV9, comprising a heavy chain having an amino acid sequence of SEQ ID NO:237, and a light chain having an amino acid sequence of SEQ ID NO:238. In one aspect, provided herein is an antibody that binds TRGV9, comprising a VH having an amino acid sequence having at least 95% identity to an amino acid sequence of SEQ ID NO:235. In one aspect, provided herein is an antibody that binds TRGV9, comprising a VL having an amino acid sequence having at least 95% identity to an amino acid sequence of SEQ ID NO:236. In one aspect, provided herein is an antibody that binds TRGV9, comprising a VH having an amino acid sequence having at least 95% identity to an amino acid sequence of SEQ ID NO:235, and a VL having an amino acid sequence having at least 95% identity to an amino acid sequence of SEQ ID NO:236. In one aspect, provided herein is an antibody that binds TRGV9, comprising a heavy chain having an amino acid sequence having at least 95% identity to an amino acid sequence of SEQ ID NO:237. In one aspect, provided herein is an antibody that binds TRGV9, comprising a light chain having an amino acid sequence having at least 95% identity to an amino acid sequence of SEQ ID NO:238. In one aspect, provided herein is an antibody that binds TRGV9, comprising a heavy chain having an amino acid sequence having at least 95% identity to an amino acid sequence of SEQ ID NO:237, and a light chain having an amino acid sequence having at least 95% identity to an amino acid sequence of SEQ ID NO:238.

In one aspect, provided herein is an antibody that binds TRGV9, comprising: (i) a VH comprising a VH CDR1, a VH CDR2, and a VH CDR3 having an amino acid sequence of SEQ ID NOs:239, 240, and 241, respectively, and (ii) a VL comprising a VL CDR1, VL CDR2, and VL CDR3 having an amino acid sequence of SEQ ID NOs:242, 243, and 244, respectively. In one aspect, provided herein is an antibody that binds TRGV9, comprising: (i) a VH comprising a VH CDR1, a VH CDR2, and a VH CDR3 having an amino acid sequence of SEQ ID NOs:245, 246, and 247, respectively, and (ii) a VL comprising a VL CDR1, VL CDR2, and VL CDR3 having an amino acid sequence of SEQ ID NOs:248, 249, and 250, respectively. In one aspect, provided herein is an antibody that binds TRGV9, comprising: (i) a VH comprising a VH CDR1, a VH CDR2, and a VH CDR3 having an amino acid sequence of SEQ ID NOs:251, 252, and 253, respectively, and (ii) a VL comprising a VL CDR1, VL CDR2, and VL CDR3 having an amino acid sequence of SEQ ID NOs:254, 255, and 256, respectively. In one aspect, provided herein is an antibody that binds TRGV9, comprising: (i) a VH comprising a VH CDR1, a VH CDR2, and a VH CDR3 having an amino acid sequence of SEQ ID NOs:257, 258, and 259, respectively, and (ii) a VL comprising a VL CDR1, VL CDR2, and VL CDR3 having an amino acid sequence of SEQ ID NOs:260, 261, and 262, respectively. In one aspect, provided herein is an antibody that binds TRGV9, comprising: (i) a VH comprising a VH CDR1, a VH CDR2, and a VH CDR3 having an amino acid sequence of SEQ ID NOs:263, 264, and 265, respectively, and (ii) a VL comprising a VL CDR1, VL CDR2, and VL CDR3 having an amino acid sequence of SEQ ID NOs:266, 267, and 268, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and (ii) a VL comprising a VL CDR1, a VL CDR2, and a VL CDR3 having an amino acid sequence of a VL CDR1, a VL CDR2, and a VL CDR3, respectively, of SEQ ID NO:270. In one aspect, provided herein is an antibody that binds TRGV9, comprising a VH having an amino acid sequence of SEQ ID NO:269. In one aspect, provided herein is an antibody that binds TRGV9, comprising a VL having an amino acid sequence of SEQ ID NO:270. In one aspect, provided herein is an antibody that binds TRGV9, comprising a VH having an amino acid sequence of SEQ ID NO:269, and a VL having an amino acid sequence of SEQ ID NO:270. In one aspect, provided herein is an antibody that binds TRGV9, comprising a heavy chain having an amino acid sequence of SEQ ID NO:271. In one aspect, provided herein is an antibody that binds TRGV9, comprising a light chain having an amino acid sequence of SEQ ID NO:272. In one aspect, provided herein is an antibody that binds TRGV9, comprising a heavy chain having an amino acid sequence of SEQ ID NO:271, and a light chain having an amino acid sequence of SEQ ID NO:272. In one aspect, provided herein is an antibody that binds TRGV9, comprising a VH having an amino acid sequence having at least 95% identity to an amino acid sequence of SEQ ID NO:269. In one aspect, provided herein is an antibody that binds TRGV9, comprising a VL having an amino acid sequence having at least 95% identity to an amino acid sequence of SEQ ID NO:270. In one aspect, provided herein is an antibody that binds TRGV9, comprising a VH having an amino acid sequence having at least 95% identity to an amino acid sequence of SEQ ID NO:269, and a VL having an amino acid sequence having at least 95% identity to an amino acid sequence of SEQ ID NO:270. In one aspect, provided herein is an antibody that binds TRGV9, comprising a heavy chain having an amino acid sequence having at least 95% identity to an amino acid sequence of SEQ ID NO:271. In one aspect, provided herein is an antibody that binds TRGV9, comprising a light chain having an amino acid sequence having at least 95% identity to an amino acid sequence of SEQ ID NO:272. In one aspect, provided herein is an antibody that binds TRGV9, comprising a heavy chain having an amino acid sequence having at least 95% identity to an amino acid sequence of SEQ ID NO:271, and a light chain having an amino acid sequence having at least 95% identity to an amino acid sequence of SEQ ID NO:272.

In one aspect, provided herein is an antibody that binds TRGV9, comprising: (i) a VH comprising a VH CDR1, a VH CDR2, and a VH CDR3 having an amino acid sequence of SEQ ID NOs:273, 274, and 275, respectively, and (ii) a VL comprising a VL CDR1, VL CDR2, and VL CDR3 having an amino acid sequence of SEQ ID NOs:276, 277, and 278, respectively. In one aspect, provided herein is an antibody that binds TRGV9, comprising: (i) a VH comprising a VH CDR1, a VH CDR2, and a VH CDR3 having an amino acid sequence of SEQ ID NOs:279, 280, and 281, respectively, and (ii) a VL comprising a VL CDR1, VL CDR2, and VL CDR3 having an amino acid sequence of SEQ ID NOs:282, 283, and 284, respectively. In one aspect, provided herein is an antibody that binds TRGV9, comprising: (i) a VH comprising a VH CDR1, a VH CDR2, and a VH CDR3 having an amino acid sequence of SEQ ID NOs:285, 286, and 287, respectively, and (ii) a VL comprising a VL CDR1, VL CDR2, and VL CDR3 having an amino acid sequence of SEQ ID NOs:288, 289, and 290, respectively. In one aspect, provided herein is an antibody that binds TRGV9, comprising: (i) a VH comprising a VH CDR1, a VH CDR2, and a VH CDR3 having an amino acid sequence of SEQ ID NOs:291, 292, and 293, respectively, and (ii) a VL comprising a VL CDR1, VL CDR2, and VL CDR3 having an amino acid sequence of SEQ ID NOs:294, 295, and 296, respectively. In one aspect, provided herein is an antibody that binds TRGV9, comprising: (i) a VH comprising a VH CDR1, a VH CDR2, and a VH CDR3 having an amino acid sequence of SEQ ID NOs:297, 298, and 299, respectively, and (ii) a VL comprising a VL CDR1, VL CDR2, and VL CDR3 having an amino acid sequence of SEQ ID NOs:300, 301, and 302, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and (ii) a VL comprising a VL CDR1, a VL CDR2, and a VL CDR3 having an amino acid sequence of a VL CDR1, a VL CDR2, and a VL CDR3, respectively, of SEQ ID NO:304. In one aspect, provided herein is an antibody that binds TRGV9, comprising a VH having an amino acid sequence of SEQ ID NO:303. In one aspect, provided herein is an antibody that binds TRGV9, comprising a VL having an amino acid sequence of SEQ ID NO:304. In one aspect, provided herein is an antibody that binds TRGV9, comprising a VH having an amino acid sequence of SEQ ID NO:303, and a VL having an amino acid sequence of SEQ ID NO:304. In one aspect, provided herein is an antibody that binds TRGV9, comprising a heavy chain having an amino acid sequence of SEQ ID NO:305. In one aspect, provided herein is an antibody that binds TRGV9, comprising a light chain having an amino acid sequence of SEQ ID NO:306. In one aspect, provided herein is an antibody that binds TRGV9, comprising a heavy chain having an amino acid sequence of SEQ ID NO:305, and a light chain having an amino acid sequence of SEQ ID NO:306. In one aspect, provided herein is an antibody that binds TRGV9, comprising a VH having an amino acid sequence having at least 95% identity to an amino acid sequence of SEQ ID NO:303. In one aspect, provided herein is an antibody that binds TRGV9, comprising a VL having an amino acid sequence having at least 95% identity to an amino acid sequence of SEQ ID NO:304. In one aspect, provided herein is an antibody that binds TRGV9, comprising a VH having an amino acid sequence having at least 95% identity to an amino acid sequence of SEQ ID NO:303, and a VL having an amino acid sequence having at least 95% identity to an amino acid sequence of SEQ ID NO:304. In one aspect, provided herein is an antibody that binds TRGV9, comprising a heavy chain having an amino acid sequence having at least 95% identity to an amino acid sequence of SEQ ID NO:305. In one aspect, provided herein is an antibody that binds TRGV9, comprising a light chain having an amino acid sequence having at least 95% identity to an amino acid sequence of SEQ ID NO:306. In one aspect, provided herein is an antibody that binds TRGV9, comprising a heavy chain having an amino acid sequence having at least 95% identity to an amino acid sequence of SEQ ID NO:305, and a light chain having an amino acid sequence having at least 95% identity to an amino acid sequence of SEQ ID NO:306.

In one aspect, provided herein is an antibody that binds TRGV9, comprising: (i) a VH comprising a VH CDR1, a VH CDR2, and a VH CDR3 having an amino acid sequence of SEQ ID NOs:307, 308, and 309, respectively, and (ii) a VL comprising a VL CDR1, VL CDR2, and VL CDR3 having an amino acid sequence of SEQ ID NOs:310, 311, and 312, respectively. In one aspect, provided herein is an antibody that binds TRGV9, comprising: (i) a VH comprising a VH CDR1, a VH CDR2, and a VH CDR3 having an amino acid sequence of SEQ ID NOs:313, 314, and 315, respectively, and (ii) a VL comprising a VL CDR1, VL CDR2, and VL CDR3 having an amino acid sequence of SEQ ID NOs:316, 317, and 318, respectively. In one aspect, provided herein is an antibody that binds TRGV9, comprising: (i) a VH comprising a VH CDR1, a VH CDR2, and a VH CDR3 having an amino acid sequence of SEQ ID NOs:319, 320, and 321, respectively, and (ii) a VL comprising a VL CDR1, VL CDR2, and VL CDR3 having an amino acid sequence of SEQ ID NOs:322, 323, and 324, respectively. In one aspect, provided herein is an antibody that binds TRGV9, comprising: (i) a VH comprising a VH CDR1, a VH CDR2, and a VH CDR3 having an amino acid sequence of SEQ ID NOs:325, 326, and 327, respectively, and (ii) a VL comprising a VL CDR1, VL CDR2, and VL CDR3 having an amino acid sequence of SEQ ID NOs:328, 329, and 330, respectively. In one aspect, provided herein is an antibody that binds TRGV9, comprising: (i) a VH comprising a VH CDR1, a VH CDR2, and a VH CDR3 having an amino acid sequence of SEQ ID NOs:331, 332, and 333, respectively, and (ii) a VL comprising a VL CDR1, VL CDR2, and VL CDR3 having an amino acid sequence of SEQ ID NOs:334, 335, and 336, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and (ii) a VL comprising a VL CDR1, a VL CDR2, and a VL CDR3 having an amino acid sequence of a VL CDR1, a VL CDR2, and a VL CDR3, respectively, of SEQ ID NO:338. In one aspect, provided herein is an antibody that binds TRGV9, comprising a VH having an amino acid sequence of SEQ ID NO:337. In one aspect, provided herein is an antibody that binds TRGV9, comprising a VL having an amino acid sequence of SEQ ID NO:338. In one aspect, provided herein is an antibody that binds TRGV9, comprising a VH having an amino acid sequence of SEQ ID NO:337, and a VL having an amino acid sequence of SEQ ID NO:338. In one aspect, provided herein is an antibody that binds TRGV9, comprising a heavy chain having an amino acid sequence of SEQ ID NO:339. In one aspect, provided herein is an antibody that binds TRGV9, comprising a light chain having an amino acid sequence of SEQ ID NO:340. In one aspect, provided herein is an antibody that binds TRGV9, comprising a heavy chain having an amino acid sequence of SEQ ID NO:339, and a light chain having an amino acid sequence of SEQ ID NO:340. In one aspect, provided herein is an antibody that binds TRGV9, comprising a VH having an amino acid sequence having at least 95% identity to an amino acid sequence of SEQ ID NO:337. In one aspect, provided herein is an antibody that binds TRGV9, comprising a VL having an amino acid sequence having at least 95% identity to an amino acid sequence of SEQ ID NO:338. In one aspect, provided herein is an antibody that binds TRGV9, comprising a VH having an amino acid sequence having at least 95% identity to an amino acid sequence of SEQ ID NO:337, and a VL having an amino acid sequence having at least 95% identity to an amino acid sequence of SEQ ID NO:338. In one aspect, provided herein is an antibody that binds TRGV9, comprising a heavy chain having an amino acid sequence having at least 95% identity to an amino acid sequence of SEQ ID NO:339. In one aspect, provided herein is an antibody that binds TRGV9, comprising a light chain having an amino acid sequence having at least 95% identity to an amino acid sequence of SEQ ID NO:340. In one aspect, provided herein is an antibody that binds TRGV9, comprising a heavy chain having an amino acid sequence having at least 95% identity to an amino acid sequence of SEQ ID NO:339, and a light chain having an amino acid sequence having at least 95% identity to an amino acid sequence of SEQ ID NO:340.

In one aspect, provided herein is an antibody that binds TRGV9, comprising: (i) a VH comprising a VH CDR1, a VH CDR2, and a VH CDR3 having an amino acid sequence of SEQ ID NOs:341, 342, and 343, respectively, and (ii) a VL comprising a VL CDR1, VL CDR2, and VL CDR3 having an amino acid sequence of SEQ ID NOs:344, 345, and 346, respectively. In one aspect, provided herein is an antibody that binds TRGV9, comprising: (i) a VH comprising a VH CDR1, a VH CDR2, and a VH CDR3 having an amino acid sequence of SEQ ID NOs:347, 348, and 349, respectively, and (ii) a VL comprising a VL CDR1, VL CDR2, and VL CDR3 having an amino acid sequence of SEQ ID NOs:350, 351, and 352, respectively. In one aspect, provided herein is an antibody that binds TRGV9, comprising: (i) a VH comprising a VH CDR1, a VH CDR2, and a VH CDR3 having an amino acid sequence of SEQ ID NOs:353, 354, and 355, respectively, and (ii) a VL comprising a VL CDR1, VL CDR2, and VL CDR3 having an amino acid sequence of SEQ ID NOs:356, 357, and 358, respectively. In one aspect, provided herein is an antibody that binds TRGV9, comprising: (i) a VH comprising a VH CDR1, a VH CDR2, and a VH CDR3 having an amino acid sequence of SEQ ID NOs:359, 360, and 361, respectively, and (ii) a VL comprising a VL CDR1, VL CDR2, and VL CDR3 having an amino acid sequence of SEQ ID NOs:362, 363, and 364, respectively. In one aspect, provided herein is an antibody that binds TRGV9, comprising: (i) a VH comprising a VH CDR1, a VH CDR2, and a VH CDR3 having an amino acid sequence of SEQ ID NOs:365, 366, and 367, respectively, and (ii) a VL comprising a VL CDR1, VL CDR2, and VL CDR3 having an amino acid sequence of SEQ ID NOs:368, 369, and 370, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and (ii) a VL comprising a VL CDR1, a VL CDR2, and a VL CDR3 having an amino acid sequence of a VL CDR1, a VL CDR2, and a VL CDR3, respectively, of SEQ ID NO:372. In one aspect, provided herein is an antibody that binds TRGV9, comprising a VH having an amino acid sequence of SEQ ID NO:371. In one aspect, provided herein is an antibody that binds TRGV9, comprising a VL having an amino acid sequence of SEQ ID NO:372. In one aspect, provided herein is an antibody that binds TRGV9, comprising a VH having an amino acid sequence of SEQ ID NO:371, and a VL having an amino acid sequence of SEQ ID NO:372. In one aspect, provided herein is an antibody that binds TRGV9, comprising a heavy chain having an amino acid sequence of SEQ ID NO:373. In one aspect, provided herein is an antibody that binds TRGV9, comprising a light chain having an amino acid sequence of SEQ ID NO:374. In one aspect, provided herein is an antibody that binds TRGV9, comprising a heavy chain having an amino acid sequence of SEQ ID NO:373, and a light chain having an amino acid sequence of SEQ ID NO:374. In one aspect, provided herein is an antibody that binds TRGV9, comprising a VH having an amino acid sequence having at least 95% identity to an amino acid sequence of SEQ ID NO:371. In one aspect, provided herein is an antibody that binds TRGV9, comprising a VL having an amino acid sequence having at least 95% identity to an amino acid sequence of SEQ ID NO:372. In one aspect, provided herein is an antibody that binds TRGV9, comprising a VH having an amino acid sequence having at least 95% identity to an amino acid sequence of SEQ ID NO:371, and a VL having an amino acid sequence having at least 95% identity to an amino acid sequence of SEQ ID NO:372. In one aspect, provided herein is an antibody that binds TRGV9, comprising a heavy chain having an amino acid sequence having at least 95% identity to an amino acid sequence of SEQ ID NO:373. In one aspect, provided herein is an antibody that binds TRGV9, comprising a light chain having an amino acid sequence having at least 95% identity to an amino acid sequence of SEQ ID NO:374. In one aspect, provided herein is an antibody that binds TRGV9, comprising a heavy chain having an amino acid sequence having at least 95% identity to an amino acid sequence of SEQ ID NO:373, and a light chain having an amino acid sequence having at least 95% identity to an amino acid sequence of SEQ ID NO:374.

In one aspect, provided herein is an antibody that binds TRGV9, comprising: (i) a VH comprising a VH CDR1, a VH CDR2, and a VH CDR3 having an amino acid sequence of SEQ ID NOs:375, 376, and 377, respectively, and (ii) a VL comprising a VL CDR1, VL CDR2, and VL CDR3 having an amino acid sequence of SEQ ID NOs:378, 379, and 380, respectively. In one aspect, provided herein is an antibody that binds TRGV9, comprising: (i) a VH comprising a VH CDR1, a VH CDR2, and a VH CDR3 having an amino acid sequence of SEQ ID NOs:381, 382, and 383, respectively, and (ii) a VL comprising a VL CDR1, VL CDR2, and VL CDR3 having an amino acid sequence of SEQ ID NOs:384, 385, and 386, respectively. In one aspect, provided herein is an antibody that binds TRGV9, comprising: (i) a VH comprising a VH CDR1, a VH CDR2, and a VH CDR3 having an amino acid sequence of SEQ ID NOs:387, 388, and 389, respectively, and (ii) a VL comprising a VL CDR1, VL CDR2, and VL CDR3 having an amino acid sequence of SEQ ID NOs:390, 391, and 392, respectively. In one aspect, provided herein is an antibody that binds TRGV9, comprising: (i) a VH comprising a VH CDR1, a VH CDR2, and a VH CDR3 having an amino acid sequence of SEQ ID NOs:393, 394, and 395, respectively, and (ii) a VL comprising a VL CDR1, VL CDR2, and VL CDR3 having an amino acid sequence of SEQ ID NOs:396, 397, and 398, respectively. In one aspect, provided herein is an antibody that binds TRGV9, comprising: (i) a VH comprising a VH CDR1, a VH CDR2, and a VH CDR3 having an amino acid sequence of SEQ ID NOs:399, 400, and 401, respectively, and (ii) a VL comprising a VL CDR1, VL CDR2, and VL CDR3 having an amino acid sequence of SEQ ID NOs:402, 403, and 404, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and (ii) a VL comprising a VL CDR1, a VL CDR2, and a VL CDR3 having an amino acid sequence of a VL CDR1, a VL CDR2, and a VL CDR3, respectively, of SEQ ID NO:406. In one aspect, provided herein is an antibody that binds TRGV9, comprising a VH having an amino acid sequence of SEQ ID NO:405. In one aspect, provided herein is an antibody that binds TRGV9, comprising a VL having an amino acid sequence of SEQ ID NO:406. In one aspect, provided herein is an antibody that binds TRGV9, comprising a VH having an amino acid sequence of SEQ ID NO:405, and a VL having an amino acid sequence of SEQ ID NO:406. In one aspect, provided herein is an antibody that binds TRGV9, comprising a heavy chain having an amino acid sequence of SEQ ID NO:407. In one aspect, provided herein is an antibody that binds TRGV9, comprising a light chain having an amino acid sequence of SEQ ID NO:408. In one aspect, provided herein is an antibody that binds TRGV9, comprising a heavy chain having an amino acid sequence of SEQ ID NO:407, and a light chain having an amino acid sequence of SEQ ID NO:408. In one aspect, provided herein is an antibody that binds TRGV9, comprising a VH having an amino acid sequence having at least 95% identity to an amino acid sequence of SEQ ID NO:405. In one aspect, provided herein is an antibody that binds TRGV9, comprising a VL having an amino acid sequence having at least 95% identity to an amino acid sequence of SEQ ID NO:406. In one aspect, provided herein is an antibody that binds TRGV9, comprising a VH having an amino acid sequence having at least 95% identity to an amino acid sequence of SEQ ID NO:405, and a VL having an amino acid sequence having at least 95% identity to an amino acid sequence of SEQ ID NO:406. In one aspect, provided herein is an antibody that binds TRGV9, comprising a heavy chain having an amino acid sequence having at least 95% identity to an amino acid sequence of SEQ ID NO:407. In one aspect, provided herein is an antibody that binds TRGV9, comprising a light chain having an amino acid sequence having at least 95% identity to an amino acid sequence of SEQ ID NO:408. In one aspect, provided herein is an antibody that binds TRGV9, comprising a heavy chain having an amino acid sequence having at least 95% identity to an amino acid sequence of SEQ ID NO:407, and a light chain having an amino acid sequence having at least 95% identity to an amino acid sequence of SEQ ID NO:408.

In one aspect, provided herein is an antibody that binds TRGV9, comprising: (i) a VH comprising a VH CDR1, a VH CDR2, and a VH CDR3 having an amino acid sequence of SEQ ID NOs:409, 410, and 411, respectively, and (ii) a VL comprising a VL CDR1, VL CDR2, and VL CDR3 having an amino acid sequence of SEQ ID NOs:412, 413, and 414, respectively. In one aspect, provided herein is an antibody that binds TRGV9, comprising: (i) a VH comprising a VH CDR1, a VH CDR2, and a VH CDR3 having an amino acid sequence of SEQ ID NOs:415, 416, and 417, respectively, and (ii) a VL comprising a VL CDR1, VL CDR2, and VL CDR3 having an amino acid sequence of SEQ ID NOs:418, 419, and 420, respectively. In one aspect, provided herein is an antibody that binds TRGV9, comprising: (i) a VH comprising a VH CDR1, a VH CDR2, and a VH CDR3 having an amino acid sequence of SEQ ID NOs:421, 422, and 423, respectively, and (ii) a VL comprising a VL CDR1, VL CDR2, and VL CDR3 having an amino acid sequence of SEQ ID NOs:424, 425, and 426, respectively. In one aspect, provided herein is an antibody that binds TRGV9, comprising: (i) a VH comprising a VH CDR1, a VH CDR2, and a VH CDR3 having an amino acid sequence of SEQ ID NOs:427, 428, and 429, respectively, and (ii) a VL comprising a VL CDR1, VL CDR2, and VL CDR3 having an amino acid sequence of SEQ ID NOs:430, 431, and 432, respectively. In one aspect, provided herein is an antibody that binds TRGV9, comprising: (i) a VH comprising a VH CDR1, a VH CDR2, and a VH CDR3 having an amino acid sequence of SEQ ID NOs:433, 434, and 435, respectively, and (ii) a VL comprising a VL CDR1, VL CDR2, and VL CDR3 having an amino acid sequence of SEQ ID NOs:436, 437, and 438, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and (ii) a VL comprising a VL CDR1, a VL CDR2, and a VL CDR3 having an amino acid sequence of a VL CDR1, a VL CDR2, and a VL CDR3, respectively, of SEQ ID NO:440. In one aspect, provided herein is an antibody that binds TRGV9, comprising a VH having an amino acid sequence of SEQ ID NO:439. In one aspect, provided herein is an antibody that binds TRGV9, comprising a VL having an amino acid sequence of SEQ ID NO:440. In one aspect, provided herein is an antibody that binds TRGV9, comprising a VH having an amino acid sequence of SEQ ID NO:439, and a VL having an amino acid sequence of SEQ ID NO:440. In one aspect, provided herein is an antibody that binds TRGV9, comprising a heavy chain having an amino acid sequence of SEQ ID NO:441. In one aspect, provided herein is an antibody that binds TRGV9, comprising a light chain having an amino acid sequence of SEQ ID NO:442. In one aspect, provided herein is an antibody that binds TRGV9, comprising a heavy chain having an amino acid sequence of SEQ ID NO:441, and a light chain having an amino acid sequence of SEQ ID NO:442. In one aspect, provided herein is an antibody that binds TRGV9, comprising a VH having an amino acid sequence having at least 95% identity to an amino acid sequence of SEQ ID NO:439. In one aspect, provided herein is an antibody that binds TRGV9, comprising a VL having an amino acid sequence having at least 95% identity to an amino acid sequence of SEQ ID NO:440. In one aspect, provided herein is an antibody that binds TRGV9, comprising a VH having an amino acid sequence having at least 95% identity to an amino acid sequence of SEQ ID NO:439, and a VL having an amino acid sequence having at least 95% identity to an amino acid sequence of SEQ ID NO:440. In one aspect, provided herein is an antibody that binds TRGV9, comprising a heavy chain having an amino acid sequence having at least 95% identity to an amino acid sequence of SEQ ID NO:441. In one aspect, provided herein is an antibody that binds TRGV9, comprising a light chain having an amino acid sequence having at least 95% identity to an amino acid sequence of SEQ ID NO:442. In one aspect, provided herein is an antibody that binds TRGV9, comprising a heavy chain having an amino acid sequence having at least 95% identity to an amino acid sequence of SEQ ID NO:441, and a light chain having an amino acid sequence having at least 95% identity to an amino acid sequence of SEQ ID NO:442.

In one aspect, provided herein is an antibody that binds TRGV9, comprising: (i) a VH comprising a VH CDR1, a VH CDR2, and a VH CDR3 having an amino acid sequence of SEQ ID NOs:443, 444, and 445, respectively, and (ii) a VL comprising a VL CDR1, VL CDR2, and VL CDR3 having an amino acid sequence of SEQ ID NOs:446, 447, and 448, respectively. In one aspect, provided herein is an antibody that binds TRGV9, comprising: (i) a VH comprising a VH CDR1, a VH CDR2, and a VH CDR3 having an amino acid sequence of SEQ ID NOs:449, 450, and 451, respectively, and (ii) a VL comprising a VL CDR1, VL CDR2, and VL CDR3 having an amino acid sequence of SEQ ID NOs:452, 453, and 454, respectively. In one aspect, provided herein is an antibody that binds TRGV9, comprising: (i) a VH comprising a VH CDR1, a VH CDR2, and a VH CDR3 having an amino acid sequence of SEQ ID NOs:455, 456, and 457, respectively, and (ii) a VL comprising a VL CDR1, VL CDR2, and VL CDR3 having an amino acid sequence of SEQ ID NOs:458, 459, and 460, respectively. In one aspect, provided herein is an antibody that binds TRGV9, comprising: (i) a VH comprising a VH CDR1, a VH CDR2, and a VH CDR3 having an amino acid sequence of SEQ ID NOs:461, 462, and 463, respectively, and (ii) a VL comprising a VL CDR1, VL CDR2, and VL CDR3 having an amino acid sequence of SEQ ID NOs:464, 465, and 466, respectively. In one aspect, provided herein is an antibody that binds TRGV9, comprising: (i) a VH comprising a VH CDR1, a VH CDR2, and a VH CDR3 having an amino acid sequence of SEQ ID NOs:467, 468, and 469, respectively, and (ii) a VL comprising a VL CDR1, VL CDR2, and VL CDR3 having an amino acid sequence of SEQ ID NOs:470, 471, and 472, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and (ii) a VL comprising a VL CDR1, a VL CDR2, and a VL CDR3 having an amino acid sequence of a VL CDR1, a VL CDR2, and a VL CDR3, respectively, of SEQ ID NO:474. In one aspect, provided herein is an antibody that binds TRGV9, comprising a VH having an amino acid sequence of SEQ ID NO:473. In one aspect, provided herein is an antibody that binds TRGV9, comprising a VL having an amino acid sequence of SEQ ID NO:474. In one aspect, provided herein is an antibody that binds TRGV9, comprising a VH having an amino acid sequence of SEQ ID NO:473, and a VL having an amino acid sequence of SEQ ID NO:474. In one aspect, provided herein is an antibody that binds TRGV9, comprising a heavy chain having an amino acid sequence of SEQ ID NO:475. In one aspect, provided herein is an antibody that binds TRGV9, comprising a light chain having an amino acid sequence of SEQ ID NO:476. In one aspect, provided herein is an antibody that binds TRGV9, comprising a heavy chain having an amino acid sequence of SEQ ID NO:475, and a light chain having an amino acid sequence of SEQ ID NO:476. In one aspect, provided herein is an antibody that binds TRGV9, comprising a VH having an amino acid sequence having at least 95% identity to an amino acid sequence of SEQ ID NO:473. In one aspect, provided herein is an antibody that binds TRGV9, comprising a VL having an amino acid sequence having at least 95% identity to an amino acid sequence of SEQ ID NO:474. In one aspect, provided herein is an antibody that binds TRGV9, comprising a VH having an amino acid sequence having at least 95% identity to an amino acid sequence of SEQ ID NO:473, and a VL having an amino acid sequence having at least 95% identity to an amino acid sequence of SEQ ID NO:474. In one aspect, provided herein is an antibody that binds TRGV9, comprising a heavy chain having an amino acid sequence having at least 95% identity to an amino acid sequence of SEQ ID NO:475. In one aspect, provided herein is an antibody that binds TRGV9, comprising a light chain having an amino acid sequence having at least 95% identity to an amino acid sequence of SEQ ID NO:476. In one aspect, provided herein is an antibody that binds TRGV9, comprising a heavy chain having an amino acid sequence having at least 95% identity to an amino acid sequence of SEQ ID NO:475, and a light chain having an amino acid sequence having at least 95% identity to an amino acid sequence of SEQ ID NO:476.

In one aspect, provided herein is an antibody that binds TRGV9, comprising: (i) a VH comprising a VH CDR1, a VH CDR2, and a VH CDR3 having an amino acid sequence of SEQ ID NOs:477, 478, and 479, respectively, and (ii) a VL comprising a VL CDR1, VL CDR2, and VL CDR3 having an amino acid sequence of SEQ ID NOs:480, 481, and 482, respectively. In one aspect, provided herein is an antibody that binds TRGV9, comprising: (i) a VH comprising a VH CDR1, a VH CDR2, and a VH CDR3 having an amino acid sequence of SEQ ID NOs:483, 484, and 485, respectively, and (ii) a VL comprising a VL CDR1, VL CDR2, and VL CDR3 having an amino acid sequence of SEQ ID NOs:486, 487, and 488, respectively. In one aspect, provided herein is an antibody that binds TRGV9, comprising: (i) a VH comprising a VH CDR1, a VH CDR2, and a VH CDR3 having an amino acid sequence of SEQ ID NOs:489, 490, and 491, respectively, and (ii) a VL comprising a VL CDR1, VL CDR2, and VL CDR3 having an amino acid sequence of SEQ ID NOs:492, 493, and 494, respectively. In one aspect, provided herein is an antibody that binds TRGV9, comprising: (i) a VH comprising a VH CDR1, a VH CDR2, and a VH CDR3 having an amino acid sequence of SEQ ID NOs:495, 496, and 497, respectively, and (ii) a VL comprising a VL CDR1, VL CDR2, and VL CDR3 having an amino acid sequence of SEQ ID NOs:498, 499, and 500, respectively. In one aspect, provided herein is an antibody that binds TRGV9, comprising: (i) a VH comprising a VH CDR1, a VH CDR2, and a VH CDR3 having an amino acid sequence of SEQ ID NOs:501, 502, and 503, respectively, and (ii) a VL comprising a VL CDR1, VL CDR2, and VL CDR3 having an amino acid sequence of SEQ ID NOs:504, 505, and 506, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and (ii) a VL comprising a VL CDR1, a VL CDR2, and a VL CDR3 having an amino acid sequence of a VL CDR1, a VL CDR2, and a VL CDR3, respectively, of SEQ ID NO:508. In one aspect, provided herein is an antibody that binds TRGV9, comprising a VH having an amino acid sequence of SEQ ID NO:507. In one aspect, provided herein is an antibody that binds TRGV9, comprising a VL having an amino acid sequence of SEQ ID NO:508. In one aspect, provided herein is an antibody that binds TRGV9, comprising a VH having an amino acid sequence of SEQ ID NO:507, and a VL having an amino acid sequence of SEQ ID NO:508. In one aspect, provided herein is an antibody that binds TRGV9, comprising a heavy chain having an amino acid sequence of SEQ ID NO:509. In one aspect, provided herein is an antibody that binds TRGV9, comprising a light chain having an amino acid sequence of SEQ ID NO:510. In one aspect, provided herein is an antibody that binds TRGV9, comprising a heavy chain having an amino acid sequence of SEQ ID NO:509, and a light chain having an amino acid sequence of SEQ ID NO:510. In one aspect, provided herein is an antibody that binds TRGV9, comprising a VH having an amino acid sequence having at least 95% identity to an amino acid sequence of SEQ ID NO:507. In one aspect, provided herein is an antibody that binds TRGV9, comprising a VL having an amino acid sequence having at least 95% identity to an amino acid sequence of SEQ ID NO:508. In one aspect, provided herein is an antibody that binds TRGV9, comprising a VH having an amino acid sequence having at least 95% identity to an amino acid sequence of SEQ ID NO:507, and a VL having an amino acid sequence having at least 95% identity to an amino acid sequence of SEQ ID NO:508. In one aspect, provided herein is an antibody that binds TRGV9, comprising a heavy chain having an amino acid sequence having at least 95% identity to an amino acid sequence of SEQ ID NO:509. In one aspect, provided herein is an antibody that binds TRGV9, comprising a light chain having an amino acid sequence having at least 95% identity to an amino acid sequence of SEQ ID NO:510. In one aspect, provided herein is an antibody that binds TRGV9, comprising a heavy chain having an amino acid sequence having at least 95% identity to an amino acid sequence of SEQ ID NO:509, and a light chain having an amino acid sequence having at least 95% identity to an amino acid sequence of SEQ ID NO:510.

In one aspect, provided herein is an antibody that binds TRGV9, comprising: (i) a VH comprising a VH CDR1, a VH CDR2, and a VH CDR3 having an amino acid sequence of SEQ ID NOs:511, 512, and 513, respectively, and (ii) a VL comprising a VL CDR1, VL CDR2, and VL CDR3 having an amino acid sequence of SEQ ID NOs:514, 515, and 516, respectively. In one aspect, provided herein is an antibody that binds TRGV9, comprising: (i) a VH comprising a VH CDR1, a VH CDR2, and a VH CDR3 having an amino acid sequence of SEQ ID NOs:517, 518, and 519, respectively, and (ii) a VL comprising a VL CDR1, VL CDR2, and VL CDR3 having an amino acid sequence of SEQ ID NOs:520, 521, and 522, respectively. In one aspect, provided herein is an antibody that binds TRGV9, comprising: (i) a VH comprising a VH CDR1, a VH CDR2, and a VH CDR3 having an amino acid sequence of SEQ ID NOs:523, 524, and 525, respectively, and (ii) a VL comprising a VL CDR1, VL CDR2, and VL CDR3 having an amino acid sequence of SEQ ID NOs:526, 527, and 528, respectively. In one aspect, provided herein is an antibody that binds TRGV9, comprising: (i) a VH comprising a VH CDR1, a VH CDR2, and a VH CDR3 having an amino acid sequence of SEQ ID NOs:529, 530, and 531, respectively, and (ii) a VL comprising a VL CDR1, VL CDR2, and VL CDR3 having an amino acid sequence of SEQ ID NOs:532, 533, and 534, respectively. In one aspect, provided herein is an antibody that binds TRGV9, comprising: (i) a VH comprising a VH CDR1, a VH CDR2, and a VH CDR3 having an amino acid sequence of SEQ ID NOs:535, 536, and 537, respectively, and (ii) a VL comprising a VL CDR1, VL CDR2, and VL CDR3 having an amino acid sequence of SEQ ID NOs:538, 539, and 540, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and (ii) a VL comprising a VL CDR1, a VL CDR2, and a VL CDR3 having an amino acid sequence of a VL CDR1, a VL CDR2, and a VL CDR3, respectively, of SEQ ID NO:542. In one aspect, provided herein is an antibody that binds TRGV9, comprising a VH having an amino acid sequence of SEQ ID NO:541. In one aspect, provided herein is an antibody that binds TRGV9, comprising a VL having an amino acid sequence of SEQ ID NO:542. In one aspect, provided herein is an antibody that binds TRGV9, comprising a VH having an amino acid sequence of SEQ ID NO:541, and a VL having an amino acid sequence of SEQ ID NO:542. In one aspect, provided herein is an antibody that binds TRGV9, comprising a heavy chain having an amino acid sequence of SEQ ID NO:543. In one aspect, provided herein is an antibody that binds TRGV9, comprising a light chain having an amino acid sequence of SEQ ID NO:544. In one aspect, provided herein is an antibody that binds TRGV9, comprising a heavy chain having an amino acid sequence of SEQ ID NO:543, and a light chain having an amino acid sequence of SEQ ID NO:544. In one aspect, provided herein is an antibody that binds TRGV9, comprising a VH having an amino acid sequence having at least 95% identity to an amino acid sequence of SEQ ID NO:541. In one aspect, provided herein is an antibody that binds TRGV9, comprising a VL having an amino acid sequence having at least 95% identity to an amino acid sequence of SEQ ID NO:542. In one aspect, provided herein is an antibody that binds TRGV9, comprising a VH having an amino acid sequence having at least 95% identity to an amino acid sequence of SEQ ID NO:541, and a VL having an amino acid sequence having at least 95% identity to an amino acid sequence of SEQ ID NO:542. In one aspect, provided herein is an antibody that binds TRGV9, comprising a heavy chain having an amino acid sequence having at least 95% identity to an amino acid sequence of SEQ ID NO:543. In one aspect, provided herein is an antibody that binds TRGV9, comprising a light chain having an amino acid sequence having at least 95% identity to an amino acid sequence of SEQ ID NO:544. In one aspect, provided herein is an antibody that binds TRGV9, comprising a heavy chain having an amino acid sequence having at least 95% identity to an amino acid sequence of SEQ ID NO:543, and a light chain having an amino acid sequence having at least 95% identity to an amino acid sequence of SEQ ID NO:544.

In one aspect, provided herein is an antibody that binds TRGV9, comprising: (i) a VH comprising a VH CDR1, a VH CDR2, and a VH CDR3 having an amino acid sequence of SEQ ID NOs:545, 546, and 547, respectively, and (ii) a VL comprising a VL CDR1, VL CDR2, and VL CDR3 having an amino acid sequence of SEQ ID NOs:548, 549, and 550, respectively. In one aspect, provided herein is an antibody that binds TRGV9, comprising: (i) a VH comprising a VH CDR1, a VH CDR2, and a VH CDR3 having an amino acid sequence of SEQ ID NOs:551, 552, and 553, respectively, and (ii) a VL comprising a VL CDR1, VL CDR2, and VL CDR3 having an amino acid sequence of SEQ ID NOs:554, 555, and 556, respectively. In one aspect, provided herein is an antibody that binds TRGV9, comprising: (i) a VH comprising a VH CDR1, a VH CDR2, and a VH CDR3 having an amino acid sequence of SEQ ID NOs:557, 558, and 559, respectively, and (ii) a VL comprising a VL CDR1, VL CDR2, and VL CDR3 having an amino acid sequence of SEQ ID NOs:560, 561, and 562, respectively. In one aspect, provided herein is an antibody that binds TRGV9, comprising: (i) a VH comprising a VH CDR1, a VH CDR2, and a VH CDR3 having an amino acid sequence of SEQ ID NOs:563, 564, and 565, respectively, and (ii) a VL comprising a VL CDR1, VL CDR2, and VL CDR3 having an amino acid sequence of SEQ ID NOs:566, 567, and 568, respectively. In one aspect, provided herein is an antibody that binds TRGV9, comprising: (i) a VH comprising a VH CDR1, a VH CDR2, and a VH CDR3 having an amino acid sequence of SEQ ID NOs:569, 570, and 571, respectively, and (ii) a VL comprising a VL CDR1, VL CDR2, and VL CDR3 having an amino acid sequence of SEQ ID NOs:572, 573, and 574, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and (ii) a VL comprising a VL CDR1, a VL CDR2, and a VL CDR3 having an amino acid sequence of a VL CDR1, a VL CDR2, and a VL CDR3, respectively, of SEQ ID NO:576. In one aspect, provided herein is an antibody that binds TRGV9, comprising a VH having an amino acid sequence of SEQ ID NO:575. In one aspect, provided herein is an antibody that binds TRGV9, comprising a VL having an amino acid sequence of SEQ ID NO:576. In one aspect, provided herein is an antibody that binds TRGV9, comprising a VH having an amino acid sequence of SEQ ID NO:575, and a VL having an amino acid sequence of SEQ ID NO:576. In one aspect, provided herein is an antibody that binds TRGV9, comprising a heavy chain having an amino acid sequence of SEQ ID NO:577. In one aspect, provided herein is an antibody that binds TRGV9, comprising a light chain having an amino acid sequence of SEQ ID NO:578. In one aspect, provided herein is an antibody that binds TRGV9, comprising a heavy chain having an amino acid sequence of SEQ ID NO:577, and a light chain having an amino acid sequence of SEQ ID NO:578. In one aspect, provided herein is an antibody that binds TRGV9, comprising a VH having an amino acid sequence having at least 95% identity to an amino acid sequence of SEQ ID NO:575. In one aspect, provided herein is an antibody that binds TRGV9, comprising a VL having an amino acid sequence having at least 95% identity to an amino acid sequence of SEQ ID NO:576. In one aspect, provided herein is an antibody that binds TRGV9, comprising a VH having an amino acid sequence having at least 95% identity to an amino acid sequence of SEQ ID NO:575, and a VL having an amino acid sequence having at least 95% identity to an amino acid sequence of SEQ ID NO:576. In one aspect, provided herein is an antibody that binds TRGV9, comprising a heavy chain having an amino acid sequence having at least 95% identity to an amino acid sequence of SEQ ID NO:577. In one aspect, provided herein is an antibody that binds TRGV9, comprising a light chain having an amino acid sequence having at least 95% identity to an amino acid sequence of SEQ ID NO:578. In one aspect, provided herein is an antibody that binds TRGV9, comprising a heavy chain having an amino acid sequence having at least 95% identity to an amino acid sequence of SEQ ID NO:577, and a light chain having an amino acid sequence having at least 95% identity to an amino acid sequence of SEQ ID NO:578.

In one aspect, provided herein is an antibody that binds TRGV9, comprising: (i) a VH comprising a VH CDR1, a VH CDR2, and a VH CDR3 having an amino acid sequence of SEQ ID NOs:579, 580, and 581, respectively, and (ii) a VL comprising a VL CDR1, VL CDR2, and VL CDR3 having an amino acid sequence of SEQ ID NOs:582, 583, and 584, respectively. In one aspect, provided herein is an antibody that binds TRGV9, comprising: (i) a VH comprising a VH CDR1, a VH CDR2, and a VH CDR3 having an amino acid sequence of SEQ ID NOs:585, 586, and 587, respectively, and (ii) a VL comprising a VL CDR1, VL CDR2, and VL CDR3 having an amino acid sequence of SEQ ID NOs:588, 589, and 590, respectively. In one aspect, provided herein is an antibody that binds TRGV9, comprising: (i) a VH comprising a VH CDR1, a VH CDR2, and a VH CDR3 having an amino acid sequence of SEQ ID NOs:591, 592, and 593, respectively, and (ii) a VL comprising a VL CDR1, VL CDR2, and VL CDR3 having an amino acid sequence of SEQ ID NOs:594, 595, and 596, respectively. In one aspect, provided herein is an antibody that binds TRGV9, comprising: (i) a VH comprising a VH CDR1, a VH CDR2, and a VH CDR3 having an amino acid sequence of SEQ ID NOs:597, 598, and 599, respectively, and (ii) a VL comprising a VL CDR1, VL CDR2, and VL CDR3 having an amino acid sequence of SEQ ID NOs:600, 601, and 602, respectively. In one aspect, provided herein is an antibody that binds TRGV9, comprising: (i) a VH comprising a VH CDR1, a VH CDR2, and a VH CDR3 having an amino acid sequence of SEQ ID NOs:603, 604, and 605, respectively, and (ii) a VL comprising a VL CDR1, VL CDR2, and VL CDR3 having an amino acid sequence of SEQ ID NOs:606, 607, and 608, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and (ii) a VL comprising a VL CDR1, a VL CDR2, and a VL CDR3 having an amino acid sequence of a VL CDR1, a VL CDR2, and a VL CDR3, respectively, of SEQ ID NO:610. In one aspect, provided herein is an antibody that binds TRGV9, comprising a VH having an amino acid sequence of SEQ ID NO:609. In one aspect, provided herein is an antibody that binds TRGV9, comprising a VL having an amino acid sequence of SEQ ID NO:610. In one aspect, provided herein is an antibody that binds TRGV9, comprising a VH having an amino acid sequence of SEQ ID NO:609, and a VL having an amino acid sequence of SEQ ID NO:610. In one aspect, provided herein is an antibody that binds TRGV9, comprising a heavy chain having an amino acid sequence of SEQ ID NO:611. In one aspect, provided herein is an antibody that binds TRGV9, comprising a light chain having an amino acid sequence of SEQ ID NO:612. In one aspect, provided herein is an antibody that binds TRGV9, comprising a heavy chain having an amino acid sequence of SEQ ID NO:611, and a light chain having an amino acid sequence of SEQ ID NO:612. In one aspect, provided herein is an antibody that binds TRGV9, comprising a VH having an amino acid sequence having at least 95% identity to an amino acid sequence of SEQ ID NO:609. In one aspect, provided herein is an antibody that binds TRGV9, comprising a VL having an amino acid sequence having at least 95% identity to an amino acid sequence of SEQ ID NO:610. In one aspect, provided herein is an antibody that binds TRGV9, comprising a VH having an amino acid sequence having at least 95% identity to an amino acid sequence of SEQ ID NO:609, and a VL having an amino acid sequence having at least 95% identity to an amino acid sequence of SEQ ID NO:610. In one aspect, provided herein is an antibody that binds TRGV9, comprising a heavy chain having an amino acid sequence having at least 95% identity to an amino acid sequence of SEQ ID NO:611. In one aspect, provided herein is an antibody that binds TRGV9, comprising a light chain having an amino acid sequence having at least 95% identity to an amino acid sequence of SEQ ID NO:612. In one aspect, provided herein is an antibody that binds TRGV9, comprising a heavy chain having an amino acid sequence having at least 95% identity to an amino acid sequence of SEQ ID NO:611, and a light chain having an amino acid sequence having at least 95% identity to an amino acid sequence of SEQ ID NO:612.

In one aspect, provided herein is an antibody that binds TRGV9, comprising: (i) a VH comprising a VH CDR1, a VH CDR2, and a VH CDR3 having an amino acid sequence of SEQ ID NOs:613, 614, and 615, respectively, and (ii) a VL comprising a VL CDR1, VL CDR2, and VL CDR3 having an amino acid sequence of SEQ ID NOs:616, 617, and 618, respectively. In one aspect, provided herein is an antibody that binds TRGV9, comprising: (i) a VH comprising a VH CDR1, a VH CDR2, and a VH CDR3 having an amino acid sequence of SEQ ID NOs:619, 620, and 621, respectively, and (ii) a VL comprising a VL CDR1, VL CDR2, and VL CDR3 having an amino acid sequence of SEQ ID NOs:622, 523, and 624, respectively. In one aspect, provided herein is an antibody that binds TRGV9, comprising: (i) a VH comprising a VH CDR1, a VH CDR2, and a VH CDR3 having an amino acid sequence of SEQ ID NOs:625, 626, and 627, respectively, and (ii) a VL comprising a VL CDR1, VL CDR2, and VL CDR3 having an amino acid sequence of SEQ ID NOs:628, 629, and 630, respectively. In one aspect, provided herein is an antibody that binds TRGV9, comprising: (i) a VH comprising a VH CDR1, a VH CDR2, and a VH CDR3 having an amino acid sequence of SEQ ID NOs:631, 632, and 633, respectively, and (ii) a VL comprising a VL CDR1, VL CDR2, and VL CDR3 having an amino acid sequence of SEQ ID NOs:634, 635, and 636, respectively. In one aspect, provided herein is an antibody that binds TRGV9, comprising: (i) a VH comprising a VH CDR1, a VH CDR2, and a VH CDR3 having an amino acid sequence of SEQ ID NOs:637, 638, and 639, respectively, and (ii) a VL comprising a VL CDR1, VL CDR2, and VL CDR3 having an amino acid sequence of SEQ ID NOs:640, 641, and 642, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and (ii) a VL comprising a VL CDR1, a VL CDR2, and a VL CDR3 having an amino acid sequence of a VL CDR1, a VL CDR2, and a VL CDR3, respectively, of SEQ ID NO:644. In one aspect, provided herein is an antibody that binds TRGV9, comprising a VH having an amino acid sequence of SEQ ID NO:643. In one aspect, provided herein is an antibody that binds TRGV9, comprising a VL having an amino acid sequence of SEQ ID NO:644. In one aspect, provided herein is an antibody that binds TRGV9, comprising a VH having an amino acid sequence of SEQ ID NO:643, and a VL having an amino acid sequence of SEQ ID NO:644. In one aspect, provided herein is an antibody that binds TRGV9, comprising a heavy chain having an amino acid sequence of SEQ ID NO:645. In one aspect, provided herein is an antibody that binds TRGV9, comprising a light chain having an amino acid sequence of SEQ ID NO:646. In one aspect, provided herein is an antibody that binds TRGV9, comprising a heavy chain having an amino acid sequence of SEQ ID NO:645, and a light chain having an amino acid sequence of SEQ ID NO:646. In one aspect, provided herein is an antibody that binds TRGV9, comprising a VH having an amino acid sequence having at least 95% identity to an amino acid sequence of SEQ ID NO:643. In one aspect, provided herein is an antibody that binds TRGV9, comprising a VL having an amino acid sequence having at least 95% identity to an amino acid sequence of SEQ ID NO:644. In one aspect, provided herein is an antibody that binds TRGV9, comprising a VH having an amino acid sequence having at least 95% identity to an amino acid sequence of SEQ ID NO:643, and a VL having an amino acid sequence having at least 95% identity to an amino acid sequence of SEQ ID NO:644. In one aspect, provided herein is an antibody that binds TRGV9, comprising a heavy chain having an amino acid sequence having at least 95% identity to an amino acid sequence of SEQ ID NO:645. In one aspect, provided herein is an antibody that binds TRGV9, comprising a light chain having an amino acid sequence having at least 95% identity to an amino acid sequence of SEQ ID NO:646. In one aspect, provided herein is an antibody that binds TRGV9, comprising a heavy chain having an amino acid sequence having at least 95% identity to an amino acid sequence of SEQ ID NO:645, and a light chain having an amino acid sequence having at least 95% identity to an amino acid sequence of SEQ ID NO:646.

In one aspect, provided herein is an antibody that binds TRGV9, comprising: (i) a VH comprising a VH CDR1, a VH CDR2, and a VH CDR3 having an amino acid sequence of SEQ ID NOs:647, 648, and 649, respectively, and (ii) a VL comprising a VL CDR1, VL CDR2, and VL CDR3 having an amino acid sequence of SEQ ID NOs:650, 651, and 652, respectively. In one aspect, provided herein is an antibody that binds TRGV9, comprising: (i) a VH comprising a VH CDR1, a VH CDR2, and a VH CDR3 having an amino acid sequence of SEQ ID NOs:653, 654, and 655, respectively, and (ii) a VL comprising a VL CDR1, VL CDR2, and VL CDR3 having an amino acid sequence of SEQ ID NOs:656, 657, and 658, respectively. In one aspect, provided herein is an antibody that binds TRGV9, comprising: (i) a VH comprising a VH CDR1, a VH CDR2, and a VH CDR3 having an amino acid sequence of SEQ ID NOs:659, 660, and 661, respectively, and (ii) a VL comprising a VL CDR1, VL CDR2, and VL CDR3 having an amino acid sequence of SEQ ID NOs:662, 663, and 664, respectively. In one aspect, provided herein is an antibody that binds TRGV9, comprising: (i) a VH comprising a VH CDR1, a VH CDR2, and a VH CDR3 having an amino acid sequence of SEQ ID NOs:665, 666, and 667, respectively, and (ii) a VL comprising a VL CDR1, VL CDR2, and VL CDR3 having an amino acid sequence of SEQ ID NOs:668, 669, and 670, respectively. In one aspect, provided herein is an antibody that binds TRGV9, comprising: (i) a VH comprising a VH CDR1, a VH CDR2, and a VH CDR3 having an amino acid sequence of SEQ ID NOs:671, 672, and 673, respectively, and (ii) a VL comprising a VL CDR1, VL CDR2, and VL CDR3 having an amino acid sequence of SEQ ID NOs:674, 675, and 676, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and (ii) a VL comprising a VL CDR1, a VL CDR2, and a VL CDR3 having an amino acid sequence of a VL CDR1, a VL CDR2, and a VL CDR3, respectively, of SEQ ID NO:678. In one aspect, provided herein is an antibody that binds TRGV9, comprising a VH having an amino acid sequence of SEQ ID NO:677. In one aspect, provided herein is an antibody that binds TRGV9, comprising a VL having an amino acid sequence of SEQ ID NO:678. In one aspect, provided herein is an antibody that binds TRGV9, comprising a VH having an amino acid sequence of SEQ ID NO:677, and a VL having an amino acid sequence of SEQ ID NO:678. In one aspect, provided herein is an antibody that binds TRGV9, comprising a heavy chain having an amino acid sequence of SEQ ID NO:679. In one aspect, provided herein is an antibody that binds TRGV9, comprising a light chain having an amino acid sequence of SEQ ID NO:680. In one aspect, provided herein is an antibody that binds TRGV9, comprising a heavy chain having an amino acid sequence of SEQ ID NO:679, and a light chain having an amino acid sequence of SEQ ID NO:680. In one aspect, provided herein is an antibody that binds TRGV9, comprising a VH having an amino acid sequence having at least 95% identity to an amino acid sequence of SEQ ID NO:677. In one aspect, provided herein is an antibody that binds TRGV9, comprising a VL having an amino acid sequence having at least 95% identity to an amino acid sequence of SEQ ID NO:678. In one aspect, provided herein is an antibody that binds TRGV9, comprising a VH having an amino acid sequence having at least 95% identity to an amino acid sequence of SEQ ID NO:677, and a VL having an amino acid sequence having at least 95% identity to an amino acid sequence of SEQ ID NO:678. In one aspect, provided herein is an antibody that binds TRGV9, comprising a heavy chain having an amino acid sequence having at least 95% identity to an amino acid sequence of SEQ ID NO:679. In one aspect, provided herein is an antibody that binds TRGV9, comprising a light chain having an amino acid sequence having at least 95% identity to an amino acid sequence of SEQ ID NO:680. In one aspect, provided herein is an antibody that binds TRGV9, comprising a heavy chain having an amino acid sequence having at least 95% identity to an amino acid sequence of SEQ ID NO:679, and a light chain having an amino acid sequence having at least 95% identity to an amino acid sequence of SEQ ID NO:680.

In one aspect, provided herein is an antibody that binds TRGV9, comprising: (i) a VH comprising a VH CDR1, a VH CDR2, and a VH CDR3 having an amino acid sequence of SEQ ID NOs:681, 682, and 683, respectively, and (ii) a VL comprising a VL CDR1, VL CDR2, and VL CDR3 having an amino acid sequence of SEQ ID NOs:684, 685, and 686, respectively. In one aspect, provided herein is an antibody that binds TRGV9, comprising: (i) a VH comprising a VH CDR1, a VH CDR2, and a VH CDR3 having an amino acid sequence of SEQ ID NOs:687, 688, and 689, respectively, and (ii) a VL comprising a VL CDR1, VL CDR2, and VL CDR3 having an amino acid sequence of SEQ ID NOs:690, 691, and 692, respectively. In one aspect, provided herein is an antibody that binds TRGV9, comprising: (i) a VH comprising a VH CDR1, a VH CDR2, and a VH CDR3 having an amino acid sequence of SEQ ID NOs:693, 694, and 695, respectively, and (ii) a VL comprising a VL CDR1, VL CDR2, and VL CDR3 having an amino acid sequence of SEQ ID NOs:696, 697, and 698, respectively. In one aspect, provided herein is an antibody that binds TRGV9, comprising: (i) a VH comprising a VH CDR1, a VH CDR2, and a VH CDR3 having an amino acid sequence of SEQ ID NOs:699, 700, and 701, respectively, and (ii) a VL comprising a VL CDR1, VL CDR2, and VL CDR3 having an amino acid sequence of SEQ ID NOs:702, 703, and 704, respectively. In one aspect, provided herein is an antibody that binds TRGV9, comprising: (i) a VH comprising a VH CDR1, a VH CDR2, and a VH CDR3 having an amino acid sequence of SEQ ID NOs:705, 706, and 707, respectively, and (ii) a VL comprising a VL CDR1, VL CDR2, and VL CDR3 having an amino acid sequence of SEQ ID NOs:708, 709, and 710, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and (ii) a VL comprising a VL CDR1, a VL CDR2, and a VL CDR3 having an amino acid sequence of a VL CDR1, a VL CDR2, and a VL CDR3, respectively, of SEQ ID NO:712. In one aspect, provided herein is an antibody that binds TRGV9, comprising a VH having an amino acid sequence of SEQ ID NO:711. In one aspect, provided herein is an antibody that binds TRGV9, comprising a VL having an amino acid sequence of SEQ ID NO:712. In one aspect, provided herein is an antibody that binds TRGV9, comprising a VH having an amino acid sequence of SEQ ID NO:711, and a VL having an amino acid sequence of SEQ ID NO:712. In one aspect, provided herein is an antibody that binds TRGV9, comprising a heavy chain having an amino acid sequence of SEQ ID NO:713. In one aspect, provided herein is an antibody that binds TRGV9, comprising a light chain having an amino acid sequence of SEQ ID NO:714. In one aspect, provided herein is an antibody that binds TRGV9, comprising a heavy chain having an amino acid sequence of SEQ ID NO:713, and a light chain having an amino acid sequence of SEQ ID NO:714. In one aspect, provided herein is an antibody that binds TRGV9, comprising a VH having an amino acid sequence having at least 95% identity to an amino acid sequence of SEQ ID NO:711. In one aspect, provided herein is an antibody that binds TRGV9, comprising a VL having an amino acid sequence having at least 95% identity to an amino acid sequence of SEQ ID NO:712. In one aspect, provided herein is an antibody that binds TRGV9, comprising a VH having an amino acid sequence having at least 95% identity to an amino acid sequence of SEQ ID NO:711, and a VL having an amino acid sequence having at least 95% identity to an amino acid sequence of SEQ ID NO:712. In one aspect, provided herein is an antibody that binds TRGV9, comprising a heavy chain having an amino acid sequence having at least 95% identity to an amino acid sequence of SEQ ID NO:713. In one aspect, provided herein is an antibody that binds TRGV9, comprising a light chain having an amino acid sequence having at least 95% identity to an amino acid sequence of SEQ ID NO:714. In one aspect, provided herein is an antibody that binds TRGV9, comprising a heavy chain having an amino acid sequence having at least 95% identity to an amino acid sequence of SEQ ID NO:713, and a light chain having an amino acid sequence having at least 95% identity to an amino acid sequence of SEQ ID NO:714.

In one aspect, provided herein is an antibody that binds TRGV9, comprising: (i) a VH comprising a VH CDR1, a VH CDR2, and a VH CDR3 having an amino acid sequence of SEQ ID NOs:715, 716, and 717, respectively, and (ii) a VL comprising a VL CDR1, VL CDR2, and VL CDR3 having an amino acid sequence of SEQ ID NOs:718, 719, and 720, respectively. In one aspect, provided herein is an antibody that binds TRGV9, comprising: (i) a VH comprising a VH CDR1, a VH CDR2, and a VH CDR3 having an amino acid sequence of SEQ ID NOs:721, 722, and 723, respectively, and (ii) a VL comprising a VL CDR1, VL CDR2, and VL CDR3 having an amino acid sequence of SEQ ID NOs:724, 725, and 726, respectively. In one aspect, provided herein is an antibody that binds TRGV9, comprising: (i) a VH comprising a VH CDR1, a VH CDR2, and a VH CDR3 having an amino acid sequence of SEQ ID NOs:727, 728, and 729, respectively, and (ii) a VL comprising a VL CDR1, VL CDR2, and VL CDR3 having an amino acid sequence of SEQ ID NOs:730, 731, and 732, respectively. In one aspect, provided herein is an antibody that binds TRGV9, comprising: (i) a VH comprising a VH CDR1, a VH CDR2, and a VH CDR3 having an amino acid sequence of SEQ ID NOs:733, 734, and 735, respectively, and (ii) a VL comprising a VL CDR1, VL CDR2, and VL CDR3 having an amino acid sequence of SEQ ID NOs:736, 737, and 738, respectively. In one aspect, provided herein is an antibody that binds TRGV9, comprising: (i) a VH comprising a VH CDR1, a VH CDR2, and a VH CDR3 having an amino acid sequence of SEQ ID NOs:739, 740, and 741, respectively, and (ii) a VL comprising a VL CDR1, VL CDR2, and VL CDR3 having an amino acid sequence of SEQ ID NOs:742, 743, and 744, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and (ii) a VL comprising a VL CDR1, a VL CDR2, and a VL CDR3 having an amino acid sequence of a VL CDR1, a VL CDR2, and a VL CDR3, respectively, of SEQ ID NO:746. In one aspect, provided herein is an antibody that binds TRGV9, comprising a VH having an amino acid sequence of SEQ ID NO:745. In one aspect, provided herein is an antibody that binds TRGV9, comprising a VL having an amino acid sequence of SEQ ID NO:746. In one aspect, provided herein is an antibody that binds TRGV9, comprising a VH having an amino acid sequence of SEQ ID NO:745, and a VL having an amino acid sequence of SEQ ID NO:746. In one aspect, provided herein is an antibody that binds TRGV9, comprising a heavy chain having an amino acid sequence of SEQ ID NO:747. In one aspect, provided herein is an antibody that binds TRGV9, comprising a light chain having an amino acid sequence of SEQ ID NO:748. In one aspect, provided herein is an antibody that binds TRGV9, comprising a heavy chain having an amino acid sequence of SEQ ID NO:747, and a light chain having an amino acid sequence of SEQ ID NO:748. In one aspect, provided herein is an antibody that binds TRGV9, comprising a VH having an amino acid sequence having at least 95% identity to an amino acid sequence of SEQ ID NO:745. In one aspect, provided herein is an antibody that binds TRGV9, comprising a VL having an amino acid sequence having at least 95% identity to an amino acid sequence of SEQ ID NO:746. In one aspect, provided herein is an antibody that binds TRGV9, comprising a VH having an amino acid sequence having at least 95% identity to an amino acid sequence of SEQ ID NO:745, and a VL having an amino acid sequence having at least 95% identity to an amino acid sequence of SEQ ID NO:746. In one aspect, provided herein is an antibody that binds TRGV9, comprising a heavy chain having an amino acid sequence having at least 95% identity to an amino acid sequence of SEQ ID NO:747. In one aspect, provided herein is an antibody that binds TRGV9, comprising a light chain having an amino acid sequence having at least 95% identity to an amino acid sequence of SEQ ID NO:748. In one aspect, provided herein is an antibody that binds TRGV9, comprising a heavy chain having an amino acid sequence having at least 95% identity to an amino acid sequence of SEQ ID NO:747, and a light chain having an amino acid sequence having at least 95% identity to an amino acid sequence of SEQ ID NO:748.

In one aspect, provided herein is an antibody that binds TRGV9, comprising: (i) a VH comprising a VH CDR1, a VH CDR2, and a VH CDR3 having an amino acid sequence of SEQ ID NOs:749, 750, and 751, respectively, and (ii) a VL comprising a VL CDR1, a VL CDR2, and VL CDR3 having an amino acid sequence of SEQ ID NOs:752, 753, and 754, respectively. In one aspect, provided herein is an antibody that binds TRGV9, comprising: (i) a VH comprising a VH CDR1, a VH CDR2, and a VH CDR3 having an amino acid sequence of SEQ ID NOs:755, 756, and 757, respectively, and (ii) a VL comprising a VL CDR1, VL CDR2, and VL CDR3 having an amino acid sequence of SEQ ID NOs:758, 759, and 760, respectively. In one aspect, provided herein is an antibody that binds TRGV9, comprising: (i) a VH comprising a VH CDR1, a VH CDR2, and a VH CDR3 having an amino acid sequence of SEQ ID NOs:761, 762, and 763, respectively, and (ii) a VL comprising a VL CDR1, VL CDR2, and VL CDR3 having an amino acid sequence of SEQ ID NOs:764, 765, and 766, respectively. In one aspect, provided herein is an antibody that binds TRGV9, comprising: (i) a VH comprising a VH CDR1, a VH CDR2, and a VH CDR3 having an amino acid sequence of SEQ ID NOs:767, 768, and 769, respectively, and (ii) a VL comprising a VL CDR1, VL CDR2, and VL CDR3 having an amino acid sequence of SEQ ID NOs:770, 771, and 772, respectively. In one aspect, provided herein is an antibody that binds TRGV9, comprising: (i) a VH comprising a VH CDR1, a VH CDR2, and a VH CDR3 having an amino acid sequence of SEQ ID NOs:773, 774, and 775, respectively, and (ii) a VL comprising a VL CDR1, VL CDR2, and VL CDR3 having an amino acid sequence of SEQ ID NOs:776, 777, and 778, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and (ii) a VL comprising a VL CDR1, a VL CDR2, and a VL CDR3 having an amino acid sequence of a VL CDR1, a VL CDR2, and a VL CDR3, respectively, of SEQ ID NO:780. In one aspect, provided herein is an antibody that binds TRGV9, comprising a VH having an amino acid sequence of SEQ ID NO:779. In one aspect, provided herein is an antibody that binds TRGV9, comprising a VL having an amino acid sequence of SEQ ID NO:780. In one aspect, provided herein is an antibody that binds TRGV9, comprising a VH having an amino acid sequence of SEQ ID NO:779, and a VL having an amino acid sequence of SEQ ID NO:780. In one aspect, provided herein is an antibody that binds TRGV9, comprising a heavy chain having an amino acid sequence of SEQ ID NO:781. In one aspect, provided herein is an antibody that binds TRGV9, comprising a light chain having an amino acid sequence of SEQ ID NO:782. In one aspect, provided herein is an antibody that binds TRGV9, comprising a heavy chain having an amino acid sequence of SEQ ID NO:781, and a light chain having an amino acid sequence of SEQ ID NO:782. In one aspect, provided herein is an antibody that binds TRGV9, comprising a VH having an amino acid sequence having at least 95% identity to an amino acid sequence of SEQ ID NO:779. In one aspect, provided herein is an antibody that binds TRGV9, comprising a VL having an amino acid sequence having at least 95% identity to an amino acid sequence of SEQ ID NO:780. In one aspect, provided herein is an antibody that binds TRGV9, comprising a VH having an amino acid sequence having at least 95% identity to an amino acid sequence of SEQ ID NO:779, and a VL having an amino acid sequence having at least 95% identity to an amino acid sequence of SEQ ID NO:780. In one aspect, provided herein is an antibody that binds TRGV9, comprising a heavy chain having an amino acid sequence having at least 95% identity to an amino acid sequence of SEQ ID NO:781. In one aspect, provided herein is an antibody that binds TRGV9, comprising a light chain having an amino acid sequence having at least 95% identity to an amino acid sequence of SEQ ID NO:782. In one aspect, provided herein is an antibody that binds TRGV9, comprising a heavy chain having an amino acid sequence having at least 95% identity to an amino acid sequence of SEQ ID NO:781, and a light chain having an amino acid sequence having at least 95% identity to an amino acid sequence of SEQ ID NO:782.

In one aspect, provided herein is an antibody that binds TRGV9, comprising: (i) a VH comprising a VH CDR1, a VH CDR2, and a VH CDR3 having an amino acid sequence of SEQ ID NOs:783, 784, and 785, respectively, and (ii) a VL comprising a VL CDR1, VL CDR2, and VL CDR3 having an amino acid sequence of SEQ ID NOs:786, 787, and 788, respectively. In one aspect, provided herein is an antibody that binds TRGV9, comprising: (i) a VH comprising a VH CDR1, a VH CDR2, and a VH CDR3 having an amino acid sequence of SEQ ID NOs:789, 790, and 791, respectively, and (ii) a VL comprising a VL CDR1, VL CDR2, and VL CDR3 having an amino acid sequence of SEQ ID NOs:792, 793, and 794, respectively. In one aspect, provided herein is an antibody that binds TRGV9, comprising: (i) a VH comprising a VH CDR1, a VH CDR2, and a VH CDR3 having an amino acid sequence of SEQ ID NOs:795, 796, and 797, respectively, and (ii) a VL comprising a VL CDR1, VL CDR2, and VL CDR3 having an amino acid sequence of SEQ ID NOs:798, 799, and 800, respectively. In one aspect, provided herein is an antibody that binds TRGV9, comprising: (i) a VH comprising a VH CDR1, a VH CDR2, and a VH CDR3 having an amino acid sequence of SEQ ID NOs:801, 802, and 803, respectively, and (ii) a VL comprising a VL CDR1, VL CDR2, and VL CDR3 having an amino acid sequence of SEQ ID NOs:804, 805, and 806, respectively. In one aspect, provided herein is an antibody that binds TRGV9, comprising: (i) a VH comprising a VH CDR1, a VH CDR2, and a VH CDR3 having an amino acid sequence of SEQ ID NOs:807, 808, and 809, respectively, and (ii) a VL comprising a VL CDR1, VL CDR2, and VL CDR3 having an amino acid sequence of SEQ ID NOs:810, 811, and 812, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and (ii) a VL comprising a VL CDR1, a VL CDR2, and a VL CDR3 having an amino acid sequence of a VL CDR1, a VL CDR2, and a VL CDR3, respectively, of SEQ ID NO:814. In one aspect, provided herein is an antibody that binds TRGV9, comprising a VH having an amino acid sequence of SEQ ID NO:813. In one aspect, provided herein is an antibody that binds TRGV9, comprising a VL having an amino acid sequence of SEQ ID NO:814. In one aspect, provided herein is an antibody that binds TRGV9, comprising a VH having an amino acid sequence of SEQ ID NO:813, and a VL having an amino acid sequence of SEQ ID NO:814. In one aspect, provided herein is an antibody that binds TRGV9, comprising a heavy chain having an amino acid sequence of SEQ ID NO:815. In one aspect, provided herein is an antibody that binds TRGV9, comprising a light chain having an amino acid sequence of SEQ ID NO:816. In one aspect, provided herein is an antibody that binds TRGV9, comprising a heavy chain having an amino acid sequence of SEQ ID NO:815, and a light chain having an amino acid sequence of SEQ ID NO:816. In one aspect, provided herein is an antibody that binds TRGV9, comprising a VH having an amino acid sequence having at least 95% identity to an amino acid sequence of SEQ ID NO:813. In one aspect, provided herein is an antibody that binds TRGV9, comprising a VL having an amino acid sequence having at least 95% identity to an amino acid sequence of SEQ ID NO:814. In one aspect, provided herein is an antibody that binds TRGV9, comprising a VH having an amino acid sequence having at least 95% identity to an amino acid sequence of SEQ ID NO:813, and a VL having an amino acid sequence having at least 95% identity to an amino acid sequence of SEQ ID NO:814. In one aspect, provided herein is an antibody that binds TRGV9, comprising a heavy chain having an amino acid sequence having at least 95% identity to an amino acid sequence of SEQ ID NO:815. In one aspect, provided herein is an antibody that binds TRGV9, comprising a light chain having an amino acid sequence having at least 95% identity to an amino acid sequence of SEQ ID NO:816. In one aspect, provided herein is an antibody that binds TRGV9, comprising a heavy chain having an amino acid sequence having at least 95% identity to an amino acid sequence of SEQ ID NO:815, and a light chain having an amino acid sequence having at least 95% identity to an amino acid sequence of SEQ ID NO:816.

In one aspect, provided herein is an antibody that binds TRGV9, comprising: (i) a VH comprising a VH CDR1, a VH CDR2, and a VH CDR3 having an amino acid sequence of SEQ ID NOs:817, 818, and 819, respectively, and (ii) a VL comprising a VL CDR1, VL CDR2, and VL CDR3 having an amino acid sequence of SEQ ID NOs:820, 821, and 822, respectively. In one aspect, provided herein is an antibody that binds TRGV9, comprising: (i) a VH comprising a VH CDR1, a VH CDR2, and a VH CDR3 having an amino acid sequence of SEQ ID NOs:823, 824, and 825, respectively, and (ii) a VL comprising a VL CDR1, VL CDR2, and VL CDR3 having an amino acid sequence of SEQ ID NOs:826, 827, and 828, respectively. In one aspect, provided herein is an antibody that binds TRGV9, comprising: (i) a VH comprising a VH CDR1, a VH CDR2, and a VH CDR3 having an amino acid sequence of SEQ ID NOs:829, 830, and 831, respectively, and (ii) a VL comprising a VL CDR1, VL CDR2, and VL CDR3 having an amino acid sequence of SEQ ID NOs:832, 833, and 834, respectively. In one aspect, provided herein is an antibody that binds TRGV9, comprising: (i) a VH comprising a VH CDR1, a VH CDR2, and a VH CDR3 having an amino acid sequence of SEQ ID NOs:835, 836, and 837, respectively, and (ii) a VL comprising a VL CDR1, VL CDR2, and VL CDR3 having an amino acid sequence of SEQ ID NOs:838, 839, and 840, respectively. In one aspect, provided herein is an antibody that binds TRGV9, comprising: (i) a VH comprising a VH CDR1, a VH CDR2, and a VH CDR3 having an amino acid sequence of SEQ ID NOs:841, 842, and 843, respectively, and (ii) a VL comprising a VL CDR1, VL CDR2, and VL CDR3 having an amino acid sequence of SEQ ID NOs:844, 845, and 846, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and (ii) a VL comprising a VL CDR1, a VL CDR2, and a VL CDR3 having an amino acid sequence of a VL CDR1, a VL CDR2, and a VL CDR3, respectively, of SEQ ID NO:848. In one aspect, provided herein is an antibody that binds TRGV9, comprising a VH having an amino acid sequence of SEQ ID NO:847. In one aspect, provided herein is an antibody that binds TRGV9, comprising a VL having an amino acid sequence of SEQ ID NO:848. In one aspect, provided herein is an antibody that binds TRGV9, comprising a VH having an amino acid sequence of SEQ ID NO:847, and a VL having an amino acid sequence of SEQ ID NO:848. In one aspect, provided herein is an antibody that binds TRGV9, comprising a heavy chain having an amino acid sequence of SEQ ID NO:849. In one aspect, provided herein is an antibody that binds TRGV9, comprising a light chain having an amino acid sequence of SEQ ID NO:850. In one aspect, provided herein is an antibody that binds TRGV9, comprising a heavy chain having an amino acid sequence of SEQ ID NO:849, and a light chain having an amino acid sequence of SEQ ID NO:850. In one aspect, provided herein is an antibody that binds TRGV9, comprising a VH having an amino acid sequence having at least 95% identity to an amino acid sequence of SEQ ID NO:847. In one aspect, provided herein is an antibody that binds TRGV9, compris-ing a VL having an amino acid sequence having at least 95% identity to an amino acid sequence of SEQ ID NO:848. In one aspect, provided herein is an antibody that binds TRGV9, comprising a VH having an amino acid sequence having at least 95% identity to an amino acid sequence of SEQ ID NO:847, and a VL having an amino acid sequence having at least 95% identity to an amino acid sequence of SEQ ID NO:848. In one aspect, provided herein is an antibody that binds TRGV9, comprising a heavy chain having an amino acid sequence having at least 95% identity to an amino acid sequence of SEQ ID NO:849. In one aspect, provided herein is an antibody that binds TRGV9, comprising a light chain having an amino acid sequence having at least 95% identity to an amino acid sequence of SEQ ID NO:850. In one aspect, provided herein is an antibody that binds TRGV9, comprising a heavy chain having an amino acid sequence having at least 95% identity to an amino acid sequence of SEQ ID NO:849, and a light chain having an amino acid sequence having at least 95% identity to an amino acid sequence of SEQ ID NO:850.

In one aspect, provided herein is an antibody that binds TRGV9, comprising: (i) a VH comprising a VH CDR1, a VH CDR2, and a VH CDR3 having an amino acid sequence of SEQ ID NOs:851, 852, and 853, respectively, and (ii) a VL comprising a VL CDR1, VL CDR2, and VL CDR3 having an amino acid sequence of SEQ ID NOs:854, 855, and 856, respectively. In one aspect, provided herein is an antibody that binds TRGV9, comprising: (i) a VH comprising a VH CDR1, a VH CDR2, and a VH CDR3 having an amino acid sequence of SEQ ID NOs:857, 858, and 859, respectively, and (ii) a VL comprising a VL CDR1, VL CDR2, and VL CDR3 having an amino acid sequence of SEQ ID NOs:860, 861, and 862, respectively. In one aspect, provided herein is an antibody that binds TRGV9, comprising: (i) a VH comprising a VH CDR1, a VH CDR2, and a VH CDR3 having an amino acid sequence of SEQ ID NOs:863, 864, and 865, respectively, and (ii) a VL comprising a VL CDR1, VL CDR2, and VL CDR3 having an amino acid sequence of SEQ ID NOs:866, 867, and 868, respectively. In one aspect, provided herein is an antibody that binds TRGV9, comprising: (i) a VH comprising a VH CDR1, a VH CDR2, and a VH CDR3 having an amino acid sequence of SEQ ID NOs:869, 870, and 871, respectively, and (ii) a VL comprising a VL CDR1, VL CDR2, and VL CDR3 having an amino acid sequence of SEQ ID NOs:872, 873, and 874, respectively. In one aspect, provided herein is an antibody that binds TRGV9, comprising: (i) a VH comprising a VH CDR1, a VH CDR2, and a VH CDR3 having an amino acid sequence of SEQ ID NOs:875, 876, and 877, respectively, and (ii) a VL comprising a VL CDR1, VL CDR2, and VL CDR3 having an amino acid sequence of SEQ ID NOs:878, 879, and 880, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and (ii) a VL comprising a VL CDR1, a VL CDR2, and a VL CDR3 having an amino acid sequence of a VL CDR1, a VL CDR2, and a VL CDR3, respectively, of SEQ ID NO:882. In one aspect, provided herein is an antibody that binds TRGV9, comprising a VH having an amino acid sequence of SEQ ID NO:881. In one aspect, provided herein is an antibody that binds TRGV9, comprising a VL having an amino acid sequence of SEQ ID NO:882. In one aspect, provided herein is an antibody that binds TRGV9, comprising a VH having an amino acid sequence of SEQ ID NO:881, and a VL having an amino acid sequence of SEQ ID NO:882. In one aspect, provided herein is an antibody that binds TRGV9, comprising a heavy chain having an amino acid sequence of SEQ ID NO:883. In one aspect, provided herein is an antibody that binds TRGV9, comprising a light chain having an amino acid sequence of SEQ ID NO:884. In one aspect, provided herein is an antibody that binds TRGV9, comprising a heavy chain having an amino acid sequence of SEQ ID NO:883, and a light chain having an amino acid sequence of SEQ ID NO:884. In one aspect, provided herein is an antibody that binds TRGV9, comprising a VH having an amino acid sequence having at least 95% identity to an amino acid sequence of SEQ ID NO:881. In one aspect, provided herein is an antibody that binds TRGV9, comprising a VL having an amino acid sequence having at least 95% identity to an amino acid sequence of SEQ ID NO:882. In one aspect, provided herein is an antibody that binds TRGV9, comprising a VH having an amino acid sequence having at least 95% identity to an amino acid sequence of SEQ ID NO:881, and a VL having an amino acid sequence having at least 95% identity to an amino acid sequence of SEQ ID NO:882. In one aspect, provided herein is an antibody that binds TRGV9, comprising a heavy chain having an amino acid sequence having at least 95% identity to an amino acid sequence of SEQ ID NO:883. In one aspect, provided herein is an antibody that binds TRGV9, comprising a light chain having an amino acid sequence having at least 95% identity to an amino acid sequence of SEQ ID NO:884. In one aspect, provided herein is an antibody that binds TRGV9, comprising a heavy chain having an amino acid sequence having at least 95% identity to an amino acid sequence of SEQ ID NO:883, and a light chain having an amino acid sequence having at least 95% identity to an amino acid sequence of SEQ ID NO:884.

In one aspect, provided herein is an antibody that binds TRGV9, comprising: (i) a VH comprising a VH CDR1, a VH CDR2, and a VH CDR3 having an amino acid sequence of SEQ ID NOs:885, 886, and 887, respectively, and (ii) a VL comprising a VL CDR1, VL CDR2, and VL CDR3 having an amino acid sequence of SEQ ID NOs:888, 889, and 890, respectively. In one aspect, provided herein is an antibody that binds TRGV9, comprising: (i) a VH comprising a VH CDR1, a VH CDR2, and a VH CDR3 having an amino acid sequence of SEQ ID NOs:891, 892, and 893, respectively, and (ii) a VL comprising a VL CDR1, VL CDR2, and VL CDR3 having an amino acid sequence of SEQ ID NOs:894, 895, and 896, respectively. In one aspect, provided herein is an antibody that binds TRGV9, comprising: (i) a VH comprising a VH CDR1, a VH CDR2, and a VH CDR3 having an amino acid sequence of SEQ ID NOs:897, 898, and 899, respectively, and (ii) a VL comprising a VL CDR1, VL CDR2, and VL CDR3 having an amino acid sequence of SEQ ID NOs:900, 901, and 902, respectively. In one aspect, provided herein is an antibody that binds TRGV9, comprising: (i) a VH comprising a VH CDR1, a VH CDR2, and a VH CDR3 having an amino acid sequence of SEQ ID NOs:903, 904, and 905, respectively, and (ii) a VL comprising a VL CDR1, VL CDR2, and VL CDR3 having an amino acid sequence of SEQ ID NOs:906, 907, and 908, respectively. In one aspect, provided herein is an antibody that binds TRGV9, comprising: (i) a VH comprising a VH CDR1, a VH CDR2, and a VH CDR3 having an amino acid sequence of SEQ ID NOs:909, 910, and 911, respectively, and (ii) a VL comprising a VL CDR1, VL CDR2, and VL CDR3 having an amino acid sequence of SEQ ID NOs:912, 913, and 914, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of SEQ ID NO:915; and (ii) a VL comprising a VL CDR1, a VL CDR2, and a VL CDR3 having an amino acid sequence of a VL CDR1, a VL CDR2, and a VL CDR3, respectively, of SEQ ID NO:916. In one aspect, provided herein is an antibody that binds TRGV9, comprising a VH having an amino acid sequence of SEQ ID NO:915. In one aspect, provided herein is an antibody that binds TRGV9, comprising a VL having an amino acid sequence of SEQ ID NO:916. In one aspect, provided herein is an antibody that binds TRGV9, comprising a VH having an amino acid sequence of SEQ ID NO:915, and a VL having an amino acid sequence of SEQ ID NO:916. In one aspect, provided herein is an antibody that binds TRGV9, comprising a heavy chain having an amino acid sequence of SEQ ID NO:917. In one aspect, provided herein is an antibody that binds TRGV9, comprising a light chain having an amino acid sequence of SEQ ID NO:918. In one aspect, provided herein is an antibody that binds TRGV9, comprising a heavy chain having an amino acid sequence of SEQ ID NO:917, and a light chain having an amino acid sequence of SEQ ID NO:918. In one aspect, provided herein is an antibody that binds TRGV9, comprising a VH having an amino acid sequence having at least 95% identity to an amino acid sequence of SEQ ID NO:915. In one aspect, provided herein is an antibody that binds TRGV9, comprising a VL having an amino acid sequence having at least 95% identity to an amino acid sequence of SEQ ID NO:916. In one aspect, provided herein is an antibody that binds TRGV9, comprising a VH having an amino acid sequence having at least 95% identity to an amino acid sequence of SEQ ID NO:915, and a VL having an amino acid sequence having at least 95% identity to an amino acid sequence of SEQ ID NO:916. In one aspect, provided herein is an antibody that binds TRGV9, comprising a heavy chain having an amino acid sequence having at least 95% identity to an amino acid sequence of SEQ ID NO:917. In one aspect, provided herein is an antibody that binds TRGV9, comprising a light chain having an amino acid sequence having at least 95% identity to an amino acid sequence of SEQ ID NO:918. In one aspect, provided herein is an antibody that binds TRGV9, comprising a heavy chain having an amino acid sequence having at least 95% identity to an amino acid sequence of SEQ ID NO:917, and a light chain having an amino acid sequence having at least 95% identity to an amino acid sequence of SEQ ID NO:918.

In one aspect, provided herein is an antibody that binds TRGV9, comprising: (i) a VH comprising a VH CDR1, a VH CDR2, and a VH CDR3 having an amino acid sequence of SEQ ID NOs:919, 920, and 921, respectively, and (ii) a VL comprising a VL CDR1, VL CDR2, and VL CDR3 having an amino acid sequence of SEQ ID NOs:922, 923, and 924, respectively. In one aspect, provided herein is an antibody that binds TRGV9, comprising: (i) a VH comprising a VH CDR1, a VH CDR2, and a VH CDR3 having an amino acid sequence of SEQ ID NOs:925, 926, and 927, respectively, and (ii) a VL comprising a VL CDR1, VL CDR2, and VL CDR3 having an amino acid sequence of SEQ ID NOs:928, 929, and 930, respectively. In one aspect, provided herein is an antibody that binds TRGV9, comprising: (i) a VH comprising a VH CDR1, a VH CDR2, and a VH CDR3 having an amino acid sequence of SEQ ID NOs:931, 932, and 933, respectively, and (ii) a VL comprising a VL CDR1, VL CDR2, and VL CDR3 having an amino acid sequence of SEQ ID NOs:934, 935, and 936, respectively. In one aspect, provided herein is an antibody that binds TRGV9, comprising: (i) a VH comprising a VH CDR1, a VH CDR2, and a VH CDR3 having an amino acid sequence of SEQ ID NOs:937, 938, and 939, respectively, and (ii) a VL comprising a VL CDR1, VL CDR2, and VL CDR3 having an amino acid sequence of SEQ ID NOs:940, 941, and 942, respectively. In one aspect, provided herein is an antibody that binds TRGV9, comprising: (i) a VH comprising a VH CDR1, a VH CDR2, and a VH CDR3 having an amino acid sequence of SEQ ID NOs:943, 944, and 945, respectively, and (ii) a VL comprising a VL CDR1, VL CDR2, and VL CDR3 having an amino acid sequence of SEQ ID NOs:946, 947, and 948, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and (ii) a VL comprising a VL CDR1, a VL CDR2, and a VL CDR3 having an amino acid sequence of a VL CDR1, a VL CDR2, and a VL CDR3, respectively, of SEQ ID NO:950. In one aspect, provided herein is an antibody that binds TRGV9, comprising a VH having an amino acid sequence of SEQ ID NO:949. In one aspect, provided herein is an antibody that binds TRGV9, comprising a VL having an amino acid sequence of SEQ ID NO:950. In one aspect, provided herein is an antibody that binds TRGV9, comprising a VH having an amino acid sequence of SEQ ID NO:949, and a VL having an amino acid sequence of SEQ ID NO:950. In one aspect, provided herein is an antibody that binds TRGV9, comprising a heavy chain having an amino acid sequence of SEQ ID NO:951. In one aspect, provided herein is an antibody that binds TRGV9, comprising a light chain having an amino acid sequence of SEQ ID NO:952. In one aspect, provided herein is an antibody that binds TRGV9, comprising a heavy chain having an amino acid sequence of SEQ ID NO:951, and a light chain having an amino acid sequence of SEQ ID NO:952. In one aspect, provided herein is an antibody that binds TRGV9, comprising a VH having an amino acid sequence having at least 95% identity to an amino acid sequence of SEQ ID NO:949. In one aspect, provided herein is an antibody that binds TRGV9, comprising a VL having an amino acid sequence having at least 95% identity to an amino acid sequence of SEQ ID NO:950. In one aspect, provided herein is an antibody that binds TRGV9, comprising a VH having an amino acid sequence having at least 95% identity to an amino acid sequence of SEQ ID NO:949, and a VL having an amino acid sequence having at least 95% identity to an amino acid sequence of SEQ ID NO:950. In one aspect, provided herein is an antibody that binds TRGV9, comprising a heavy chain having an amino acid sequence having at least 95% identity to an amino acid sequence of SEQ ID NO:951. In one aspect, provided herein is an antibody that binds TRGV9, comprising a light chain having an amino acid sequence having at least 95% identity to an amino acid sequence of SEQ ID NO:952. In one aspect, provided herein is an antibody that binds TRGV9, comprising a heavy chain having an amino acid sequence having at least 95% identity to an amino acid sequence of SEQ ID NO:951, and a light chain having an amino acid sequence having at least 95% identity to an amino acid sequence of SEQ ID NO:952.

In one aspect, provided herein is an antibody that binds TRGV9, comprising: (i) a VH comprising a VH CDR1, a VH CDR2, and a VH CDR3 having an amino acid sequence of SEQ ID NOs:953, 954, and 955, respectively, and (ii) a VL comprising a VL CDR1, VL CDR2, and VL CDR3 having an amino acid sequence of SEQ ID NOs:956, 957, and 958, respectively. In one aspect, provided herein is an antibody that binds TRGV9, comprising: (i) a VH comprising a VH CDR1, a VH CDR2, and a VH CDR3 having an amino acid sequence of SEQ ID NOs:959, 960, and 961, respectively, and (ii) a VL comprising a VL CDR1, VL CDR2, and VL CDR3 having an amino acid sequence of SEQ ID NOs:962, 963, and 964, respectively. In one aspect, provided herein is an antibody that binds TRGV9, comprising: (i) a VH comprising a VH CDR1, a VH CDR2, and a VH CDR3 having an amino acid sequence of SEQ ID NOs:965, 966, and 967, respectively, and (ii) a VL comprising a VL CDR1, VL CDR2, and VL CDR3 having an amino acid sequence of SEQ ID NOs:968, 969, and 970, respectively. In one aspect, provided herein is an antibody that binds TRGV9, comprising: (i) a VH comprising a VH CDR1, a VH CDR2, and a VH CDR3 having an amino acid sequence of SEQ ID NOs:971, 972, and 973, respectively, and (ii) a VL comprising a VL CDR1, VL CDR2, and VL CDR3 having an amino acid sequence of SEQ ID NOs:974, 975, and 976, respectively. In one aspect, provided herein is an antibody that binds TRGV9, comprising: (i) a VH comprising a VH CDR1, a VH CDR2, and a VH CDR3 having an amino acid sequence of SEQ ID NOs:977, 978, and 979, respectively, and (ii) a VL comprising a VL CDR1, VL CDR2, and VL CDR3 having an amino acid sequence of SEQ ID NOs:980, 981, and 982, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and (ii) a VL comprising a VL CDR1, a VL CDR2, and a VL CDR3 having an amino acid sequence of a VL CDR1, a VL CDR2, and a VL CDR3, respectively, of SEQ ID NO:984. In one aspect, provided herein is an antibody that binds TRGV9, comprising a VH having an amino acid sequence of SEQ ID NO:983. In one aspect, provided herein is an antibody that binds TRGV9, comprising a VL having an amino acid sequence of SEQ ID NO:984. In one aspect, provided herein is an antibody that binds TRGV9, comprising a VH having an amino acid sequence of SEQ ID NO:983, and a VL having an amino acid sequence of SEQ ID NO:984. In one aspect, provided herein is an antibody that binds TRGV9, comprising a heavy chain having an amino acid sequence of SEQ ID NO:985. In one aspect, provided herein is an antibody that binds TRGV9, comprising a light chain having an amino acid sequence of SEQ ID NO:986. In one aspect, provided herein is an antibody that binds TRGV9, comprising a heavy chain having an amino acid sequence of SEQ ID NO:985, and a light chain having an amino acid sequence of SEQ ID NO:986. In one aspect, provided herein is an antibody that binds TRGV9, comprising a VH having an amino acid sequence having at least 95% identity to an amino acid sequence of SEQ ID NO:983. In one aspect, provided herein is an antibody that binds TRGV9, comprising a VL having an amino acid sequence having at least 95% identity to an amino acid sequence of SEQ ID NO:984. In one aspect, provided herein is an antibody that binds TRGV9, comprising a VH having an amino acid sequence having at least 95% identity to an amino acid sequence of SEQ ID NO:983, and a VL having an amino acid sequence having at least 95% identity to an amino acid sequence of SEQ ID NO:984. In one aspect, provided herein is an antibody that binds TRGV9, comprising a heavy chain having an amino acid sequence having at least 95% identity to an amino acid sequence of SEQ ID NO:985. In one aspect, provided herein is an antibody that binds TRGV9, comprising a light chain having an amino acid sequence having at least 95% identity to an amino acid sequence of SEQ ID NO:986. In one aspect, provided herein is an antibody that binds TRGV9, comprising a heavy chain having an amino acid sequence having at least 95% identity to an amino acid sequence of SEQ ID NO:985, and a light chain having an amino acid sequence having at least 95% identity to an amino acid sequence of SEQ ID NO:986.

In one aspect, provided herein is an antibody that binds TRGV9, comprising: (i) a VH comprising a VH CDR1, a VH CDR2, and a VH CDR3 having an amino acid sequence of SEQ ID NOs:987, 988, and 989, respectively, and (ii) a VL comprising a VL CDR1, VL CDR2, and VL CDR3 having an amino acid sequence of SEQ ID NOs:990, 991, and 992, respectively. In one aspect, provided herein is an antibody that binds TRGV9, comprising: (i) a VH comprising a VH CDR1, a VH CDR2, and a VH CDR3 having an amino acid sequence of SEQ ID NOs:993, 994, and 995, respectively, and (ii) a VL comprising a VL CDR1, VL CDR2, and VL CDR3 having an amino acid sequence of SEQ ID NOs:996, 997, and 998, respectively. In one aspect, provided herein is an antibody that binds TRGV9, comprising: (i) a VH comprising a VH CDR1, a VH CDR2, and a VH CDR3 having an amino acid sequence of SEQ ID NOs:999, 1000, and 1001, respectively, and (ii) a VL comprising a VL CDR1, VL CDR2, and VL CDR3 having an amino acid sequence of SEQ ID NOs:1002, 1003, and 1004, respectively. In one aspect, provided herein is an antibody that binds TRGV9, comprising: (i) a VH comprising a VH CDR1, a VH CDR2, and a VH CDR3 having an amino acid sequence of SEQ ID NOs:1005, 1006, and 1007, respectively, and (ii) a VL comprising a VL CDR1, VL CDR2, and VL CDR3 having an amino acid sequence of SEQ ID NOs:1008, 1009, and 1010, respectively. In one aspect, provided herein is an antibody that binds TRGV9, comprising: (i) a VH comprising a VH CDR1, a VH CDR2, and a VH CDR3 having an amino acid sequence of SEQ ID NOs:1011, 1012, and 1013, respectively, and (ii) a VL comprising a VL CDR1, VL CDR2, and VL CDR3 having an amino acid sequence of SEQ ID NOs:1014, 1015, and 1016, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and (ii) a VL comprising a VL CDR1, a VL CDR2, and a VL CDR3 having an amino acid sequence of a VL CDR1, a VL CDR2, and a VL CDR3, respectively, of SEQ ID NO:1018. In one aspect, provided herein is an antibody that binds TRGV9, comprising a VH having an amino acid sequence of SEQ ID NO:1017. In one aspect, provided herein is an antibody that binds TRGV9, comprising a VL having an amino acid sequence of SEQ ID NO:1018. In one aspect, provided herein is an antibody that binds TRGV9, comprising a VH having an amino acid sequence of SEQ ID NO:1017, and a VL having an amino acid sequence of SEQ ID NO:1018. In one aspect, provided herein is an antibody that binds TRGV9, comprising a heavy chain having an amino acid sequence of SEQ ID NO:1019. In one aspect, provided herein is an antibody that binds TRGV9, comprising a light chain having an amino acid sequence of SEQ ID NO:1020. In one aspect, provided herein is an antibody that binds TRGV9, comprising a heavy chain having an amino acid sequence of SEQ ID NO:1019, and a light chain having an amino acid sequence of SEQ ID NO:1020. In one aspect, provided herein is an antibody that binds TRGV9, comprising a VH having an amino acid sequence having at least 95% identity to an amino acid sequence of SEQ ID NO:1017. In one aspect, provided herein is an antibody that binds TRGV9, comprising a VL having an amino acid sequence having at least 95% identity to an amino acid sequence of SEQ ID NO:1018. In one aspect, provided herein is an antibody that binds TRGV9, comprising a VH having an amino acid sequence having at least 95% identity to an amino acid sequence of SEQ ID NO:1017, and a VL having an amino acid sequence having at least 95% identity to an amino acid sequence of SEQ ID NO:1018. In one aspect, provided herein is an antibody that binds TRGV9, comprising a heavy chain having an amino acid sequence having at least 95% identity to an amino acid sequence of SEQ ID NO:1019. In one aspect, provided herein is an antibody that binds TRGV9, comprising a light chain having an amino acid sequence having at least 95% identity to an amino acid sequence of SEQ ID NO:1020. In one aspect, provided herein is an antibody that binds TRGV9, comprising a heavy chain having an amino acid sequence having at least 95% identity to an amino acid sequence of SEQ ID NO:1019, and a light chain having an amino acid sequence having at least 95% identity to an amino acid sequence of SEQ ID NO:1020.

In one aspect, provided herein is an antibody that binds TRGV9, comprising: (i) a VH comprising a VH CDR1, a VH CDR2, and a VH CDR3 having an amino acid sequence of SEQ ID NOs:1021, 1022, and 1023, respectively, and (ii) a VL comprising a VL CDR1, VL CDR2, and VL CDR3 having an amino acid sequence of SEQ ID NOs:1024, 1025, and 1026, respectively. In one aspect, provided herein is an antibody that binds TRGV9, comprising: (i) a VH comprising a VH CDR1, a VH CDR2, and a VH CDR3 having an amino acid sequence of SEQ ID NOs:1027, 1028, and 1029, respectively, and (ii) a VL comprising a VL CDR1, VL CDR2, and VL CDR3 having an amino acid sequence of SEQ ID NOs:1030, 1031, and 1032, respectively. In one aspect, provided herein is an antibody that binds TRGV9, comprising: (i) a VH comprising a VH CDR1, a VH CDR2, and a VH CDR3 having an amino acid sequence of SEQ ID NOs:1033, 1034, and 1035, respectively, and (ii) a VL comprising a VL CDR1, VL CDR2, and VL CDR3 having an amino acid sequence of SEQ ID NOs:1036, 1037, and 1038, respectively. In one aspect, provided herein is an antibody that binds TRGV9, comprising: (i) a VH comprising a VH CDR1, a VH CDR2, and a VH CDR3 having an amino acid sequence of SEQ ID NOs:1039, 1040, and 1041, respectively, and (ii) a VL comprising a VL CDR1, VL CDR2, and VL CDR3 having an amino acid sequence of SEQ ID NOs:1042, 1043, and 1044, respectively. In one aspect, provided herein is an antibody that binds TRGV9, comprising: (i) a VH comprising a VH CDR1, a VH CDR2, and a VH CDR3 having an amino acid sequence of SEQ ID NOs:1045, 1046, and 1047, respectively, and (ii) a VL comprising a VL CDR1, VL CDR2, and VL CDR3 having an amino acid sequence of SEQ ID NOs:1048, 1049, and 1050, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and (ii) a VL comprising a VL CDR1, a VL CDR2, and a VL CDR3 having an amino acid sequence of a VL CDR1, a VL CDR2, and a VL CDR3, respectively, of SEQ ID NO:1052. In one aspect, provided herein is an antibody that binds TRGV9, comprising a VH having an amino acid sequence of SEQ ID NO:1051. In one aspect, provided herein is an antibody that binds TRGV9, comprising a VL having an amino acid sequence of SEQ ID NO:1052. In one aspect, provided herein is an antibody that binds TRGV9, comprising a VH having an amino acid sequence of SEQ ID NO:1051, and a VL having an amino acid sequence of SEQ ID NO:1052. In one aspect, provided herein is an antibody that binds TRGV9, comprising a heavy chain having an amino acid sequence of SEQ ID NO:1053. In one aspect, provided herein is an antibody that binds TRGV9, comprising a light chain having an amino acid sequence of SEQ ID NO:1054. In one aspect, provided herein is an antibody that binds TRGV9, comprising a heavy chain having an amino acid sequence of SEQ ID NO:1053, and a light chain having an amino acid sequence of SEQ ID NO:1054. In one aspect, provided herein is an antibody that binds TRGV9, comprising a VH having an amino acid sequence having at least 95% identity to an amino acid sequence of SEQ ID NO:1051. In one aspect, provided herein is an antibody that binds TRGV9, comprising a VL having an amino acid sequence having at least 95% identity to an amino acid sequence of SEQ ID NO:1052. In one aspect, provided herein is an antibody that binds TRGV9, comprising a VH having an amino acid sequence having at least 95% identity to an amino acid sequence of SEQ ID NO:1051, and a VL having an amino acid sequence having at least 95% identity to an amino acid sequence of SEQ ID NO:1052. In one aspect, provided herein is an antibody that binds TRGV9, comprising a heavy chain having an amino acid sequence having at least 95% identity to an amino acid sequence of SEQ ID NO:1053. In one aspect, provided herein is an antibody that binds TRGV9, comprising a light chain having an amino acid sequence having at least 95% identity to an amino acid sequence of SEQ ID NO:1054. In one aspect, provided herein is an antibody that binds TRGV9, comprising a heavy chain having an amino acid sequence having at least 95% identity to an amino acid sequence of SEQ ID NO:1053, and a light chain having an amino acid sequence having at least 95% identity to an amino acid sequence of SEQ ID NO:1054.

In one aspect, provided herein is an antibody that binds TRGV9, comprising: (i) a VH comprising a VH CDR1, a VH CDR2, and a VH CDR3 having an amino acid sequence of SEQ ID NOs:1055, 1056, and 1057, respectively, and (ii) a VL comprising a VL CDR1, VL CDR2, and VL CDR3 having an amino acid sequence of SEQ ID NOs:1058, 1059, and 1060, respectively. In one aspect, provided herein is an antibody that binds TRGV9, comprising: (i) a VH comprising a VH CDR1, a VH CDR2, and a VH CDR3 having an amino acid sequence of SEQ ID NOs:1061, 1062, and 1063, respectively, and (ii) a VL comprising a VL CDR1, VL CDR2, and VL CDR3 having an amino acid sequence of SEQ ID NOs:1064, 1065, and 1066, respectively. In one aspect, provided herein is an antibody that binds TRGV9, comprising: (i) a VH comprising a VH CDR1, a VH CDR2, and a VH CDR3 having an amino acid sequence of SEQ ID NOs:1067, 1068, and 1069, respectively, and (ii) a VL comprising a VL CDR1, VL CDR2, and VL CDR3 having an amino acid sequence of SEQ ID NOs:1070, 1071, and 1072, respectively. In one aspect, provided herein is an antibody that binds TRGV9, comprising: (i) a VH comprising a VH CDR1, a VH CDR2, and a VH CDR3 having an amino acid sequence of SEQ ID NOs:1073, 1074, and 1075, respectively, and (ii) a VL comprising a VL CDR1, VL CDR2, and VL CDR3 having an amino acid sequence of SEQ ID NOs:1076, 1077, and 1078, respectively. In one aspect, provided herein is an antibody that binds TRGV9, comprising: (i) a VH comprising a VH CDR1, a VH CDR2, and a VH CDR3 having an amino acid sequence of SEQ ID NOs:1079, 1080, and 1081, respectively, and (ii) a VL comprising a VL CDR1, VL CDR2, and VL CDR3 having an amino acid sequence of SEQ ID NOs:1082, 1083, and 1084, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and (ii) a VL comprising a VL CDR1, a VL CDR2, and a VL CDR3 having an amino acid sequence of a VL CDR1, a VL CDR2, and a VL CDR3, respectively, of SEQ ID NO:1086. In one aspect, provided herein is an antibody that binds TRGV9, comprising a VH having an amino acid sequence of SEQ ID NO:1085. In one aspect, provided herein is an antibody that binds TRGV9, comprising a VL having an amino acid sequence of SEQ ID NO:1086. In one aspect, provided herein is an antibody that binds TRGV9, comprising a VH having an amino acid sequence of SEQ ID NO:1085, and a VL having an amino acid sequence of SEQ ID NO:1086. In one aspect, provided herein is an antibody that binds TRGV9, comprising a heavy chain having an amino acid sequence of SEQ ID NO:1087. In one aspect, provided herein is an antibody that binds TRGV9, comprising a light chain having an amino acid sequence of SEQ ID NO:1088. In one aspect, provided herein is an antibody that binds TRGV9, comprising a heavy chain having an amino acid sequence of SEQ ID NO:1087, and a light chain having an amino acid sequence of SEQ ID NO:1088. In one aspect, provided herein is an antibody that binds TRGV9, comprising a VH having an amino acid sequence having at least 95% identity to an amino acid sequence of SEQ ID NO:1085. In one aspect, provided herein is an antibody that binds TRGV9, comprising a VL having an amino acid sequence having at least 95% identity to an amino acid sequence of SEQ ID NO:1086. In one aspect, provided herein is an antibody that binds TRGV9, comprising a VH having an amino acid sequence having at least 95% identity to an amino acid sequence of SEQ ID NO:1085, and a VL having an amino acid sequence having at least 95% identity to an amino acid sequence of SEQ ID NO:1086. In one aspect, provided herein is an antibody that binds TRGV9, comprising a heavy chain having an amino acid sequence having at least 95% identity to an amino acid sequence of SEQ ID NO:1087. In one aspect, provided herein is an antibody that binds TRGV9, comprising a light chain having an amino acid sequence having at least 95% identity to an amino acid sequence of SEQ ID NO:1088. In one aspect, provided herein is an antibody that binds TRGV9, comprising a heavy chain having an amino acid sequence having at least 95% identity to an amino acid sequence of SEQ ID NO:1087, and a light chain having an amino acid sequence having at least 95% identity to an amino acid sequence of SEQ ID NO:1088.

In one aspect, provided herein is an antibody that binds TRGV9, comprising: (i) a VH comprising a VH CDR1, a VH CDR2, and a VH CDR3 having an amino acid sequence of SEQ ID NOs:1089, 1090, and 1091, respectively, and (ii) a VL comprising a VL CDR1, VL CDR2, and VL CDR3 having an amino acid sequence of SEQ ID NOs:1092, 1093, and 1094, respectively. In one aspect, provided herein is an antibody that binds TRGV9, comprising: (i) a VH comprising a VH CDR1, a VH CDR2, and a VH CDR3 having an amino acid sequence of SEQ ID NOs:1095, 1096, and 1097, respectively, and (ii) a VL comprising a VL CDR1, VL CDR2, and VL CDR3 having an amino acid sequence of SEQ ID NOs:1098, 1099, and 1100, respectively. In one aspect, provided herein is an antibody that binds TRGV9, comprising: (i) a VH comprising a VH CDR1, a VH CDR2, and a VH CDR3 having an amino acid sequence of SEQ ID NOs:1101, 1102, and 1103, respectively, and (ii) a VL comprising a VL CDR1, VL CDR2, and VL CDR3 having an amino acid sequence of SEQ ID NOs:1104, 1105, and 1106, respectively. In one aspect, provided herein is an antibody that binds TRGV9, comprising: (i) a VH comprising a VH CDR1, a VH CDR2, and a VH CDR3 having an amino acid sequence of SEQ ID NOs:1107, 1108, and 1109, respectively, and (ii) a VL comprising a VL CDR1, VL CDR2, and VL CDR3 having an amino acid sequence of SEQ ID NOs:1110, 1111, and 1112, respectively. In one aspect, provided herein is an antibody that binds TRGV9, comprising: (i) a VH comprising a VH CDR1, a VH CDR2, and a VH CDR3 having an amino acid sequence of SEQ ID NOs:1113, 1114, and 1115, respectively, and (ii) a VL comprising a VL CDR1, VL CDR2, and VL CDR3 having an amino acid sequence of SEQ ID NOs:1116, 1117, and 1118, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and (ii) a VL comprising a VL CDR1, a VL CDR2, and a VL CDR3 having an amino acid sequence of a VL CDR1, a VL CDR2, and a VL CDR3, respectively, of SEQ ID NO:1120. In one aspect, provided herein is an antibody that binds TRGV9, comprising a VH having an amino acid sequence of SEQ ID NO:1119. In one aspect, provided herein is an antibody that binds TRGV9, comprising a VL having an amino acid sequence of SEQ ID NO:1120. In one aspect, provided herein is an antibody that binds TRGV9, comprising a VH having an amino acid sequence of SEQ ID NO:1119, and a VL having an amino acid sequence of SEQ ID NO:1120. In one aspect, provided herein is an antibody that binds TRGV9, comprising a heavy chain having an amino acid sequence of SEQ ID NO:1121. In one aspect, provided herein is an antibody that binds TRGV9, comprising a light chain having an amino acid sequence of SEQ ID NO:1122. In one aspect, provided herein is an antibody that binds TRGV9, comprising a heavy chain having an amino acid sequence of SEQ ID NO:1121, and a light chain having an amino acid sequence of SEQ ID NO:1122. In one aspect, provided herein is an antibody that binds TRGV9, comprising a VH having an amino acid sequence having at least 95% identity to an amino acid sequence of SEQ ID NO:1119. In one aspect, provided herein is an antibody that binds TRGV9, comprising a VL having an amino acid sequence having at least 95% identity to an amino acid sequence of SEQ ID NO:1120. In one aspect, provided herein is an antibody that binds TRGV9, comprising a VH having an amino acid sequence having at least 95% identity to an amino acid sequence of SEQ ID NO:1119, and a VL having an amino acid sequence having at least 95% identity to an amino acid sequence of SEQ ID NO:1120. In one aspect, provided herein is an antibody that binds TRGV9, comprising a heavy chain having an amino acid sequence having at least 95% identity to an amino acid sequence of SEQ ID NO:1121. In one aspect, provided herein is an antibody that binds TRGV9, comprising a light chain having an amino acid sequence having at least 95% identity to an amino acid sequence of SEQ ID NO:1122. In one aspect, provided herein is an antibody that binds TRGV9, comprising a heavy chain having an amino acid sequence having at least 95% identity to an amino acid sequence of SEQ ID NO:1121, and a light chain having an amino acid sequence having at least 95% identity to an amino acid sequence of SEQ ID NO:1122.

In one aspect, provided herein is an antibody that binds TRGV9, comprising: (i) a VH comprising a VH CDR1, a VH CDR2, and a VH CDR3 having an amino acid sequence of SEQ ID NOs:1123, 1124, and 1125, respectively, and (ii) a VL comprising a VL CDR1, VL CDR2, and VL CDR3 having an amino acid sequence of SEQ ID NOs:1126, 1127, and 1128, respectively. In one aspect, provided herein is an antibody that binds TRGV9, comprising: (i) a VH comprising a VH CDR1, a VH CDR2, and a VH CDR3 having an amino acid sequence of SEQ ID NOs:1129, 1130, and 1131, respectively, and (ii) a VL comprising a VL CDR1, VL CDR2, and VL CDR3 having an amino acid sequence of SEQ ID NOs:1132, 1133, and 1134, respectively. In one aspect, provided herein is an antibody that binds TRGV9, comprising: (i) a VH comprising a VH CDR1, a VH CDR2, and a VH CDR3 having an amino acid sequence of SEQ ID NOs:1135, 1136, and 1137, respectively, and (ii) a VL comprising a VL CDR1, VL CDR2, and VL CDR3 having an amino acid sequence of SEQ ID NOs:1138, 1139, and 1140, respectively. In one aspect, provided herein is an antibody that binds TRGV9, comprising: (i) a VH comprising a VH CDR1, a VH CDR2, and a VH CDR3 having an amino acid sequence of SEQ ID NOs:1141, 1142, and 1143, respectively, and (ii) a VL comprising a VL CDR1, VL CDR2, and VL CDR3 having an amino acid sequence of SEQ ID NOs:1144, 1145, and 1146, respectively. In one aspect, provided herein is an antibody that binds TRGV9, comprising: (i) a VH comprising a VH CDR1, a VH CDR2, and a VH CDR3 having an amino acid sequence of SEQ ID NOs:1147, 1148, and 1149, respectively, and (ii) a VL comprising a VL CDR1, VL CDR2, and VL CDR3 having an amino acid sequence of SEQ ID NOs:1150, 1151, and 1152, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and (ii) a VL comprising a VL CDR1, a VL CDR2, and a VL CDR3 having an amino acid sequence of a VL CDR1, a VL CDR2, and a VL CDR3, respectively, of SEQ ID NO:1154. In one aspect, provided herein is an antibody that binds TRGV9, comprising a VH having an amino acid sequence of SEQ ID NO:1153. In one aspect, provided herein is an antibody that binds TRGV9, comprising a VL having an amino acid sequence of SEQ ID NO:1154. In one aspect, provided herein is an antibody that binds TRGV9, comprising a VH having an amino acid sequence of SEQ ID NO:1153, and a VL having an amino acid sequence of SEQ ID NO:1154. In one aspect, provided herein is an antibody that binds TRGV9, comprising a heavy chain having an amino acid sequence of SEQ ID NO:1155. In one aspect, provided herein is an antibody that binds TRGV9, comprising a light chain having an amino acid sequence of SEQ ID NO:1156. In one aspect, provided herein is an antibody that binds TRGV9, comprising a heavy chain having an amino acid sequence of SEQ ID NO:1155, and a light chain having an amino acid sequence of SEQ ID NO:1156. In one aspect, provided herein is an antibody that binds TRGV9, comprising a VH having an amino acid sequence having at least 95% identity to an amino acid sequence of SEQ ID NO:1153. In one aspect, provided herein is an antibody that binds TRGV9, comprising a VL having an amino acid sequence having at least 95% identity to an amino acid sequence of SEQ ID NO:1154. In one aspect, provided herein is an antibody that binds TRGV9, comprising a VH having an amino acid sequence having at least 95% identity to an amino acid sequence of SEQ ID NO:1153, and a VL having an amino acid sequence having at least 95% identity to an amino acid sequence of SEQ ID NO:1154. In one aspect, provided herein is an antibody that binds TRGV9, comprising a heavy chain having an amino acid sequence having at least 95% identity to an amino acid sequence of SEQ ID NO:1155. In one aspect, provided herein is an antibody that binds TRGV9, comprising a light chain having an amino acid sequence having at least 95% identity to an amino acid sequence of SEQ ID NO:1156. In one aspect, provided herein is an antibody that binds TRGV9, comprising a heavy chain having an amino acid sequence having at least 95% identity to an amino acid sequence of SEQ ID NO:1155, and a light chain having an amino acid sequence having at least 95% identity to an amino acid sequence of SEQ ID NO:1156.

In one aspect, provided herein is an antibody that binds TRGV9, comprising: (i) a VH comprising a VH CDR1, a VH CDR2, and a VH CDR3 having an amino acid sequence of SEQ ID NOs:1157, 1158, and 1159, respectively, and (ii) a VL comprising a VL CDR1, VL CDR2, and VL CDR3 having an amino acid sequence of SEQ ID NOs:1160, 1161, and 1162, respectively. In one aspect, provided herein is an antibody that binds TRGV9, comprising: (i) a VH comprising a VH CDR1, a VH CDR2, and a VH CDR3 having an amino acid sequence of SEQ ID NOs:1163, 1164, and 1165, respectively, and (ii) a VL comprising a VL CDR1, VL CDR2, and VL CDR3 having an amino acid sequence of SEQ ID NOs:1166, 1167, and 1168, respectively. In one aspect, provided herein is an antibody that binds TRGV9, comprising: (i) a VH comprising a VH CDR1, a VH CDR2, and a VH CDR3 having an amino acid sequence of SEQ ID NOs:1169, 1170, and 1171, respectively, and (ii) a VL comprising a VL CDR1, VL CDR2, and VL CDR3 having an amino acid sequence of SEQ ID NOs:1172, 1173, and 1174, respectively. In one aspect, provided herein is an antibody that binds TRGV9, comprising: (i) a VH comprising a VH CDR1, a VH CDR2, and a VH CDR3 having an amino acid sequence of SEQ ID NOs:1175, 1176, and 1177, respectively, and (ii) a VL comprising a VL CDR1, VL CDR2, and VL CDR3 having an amino acid sequence of SEQ ID NOs:1178, 1179, and 1180, respectively. In one aspect, provided herein is an antibody that binds TRGV9, comprising: (i) a VH comprising a VH CDR1, a VH CDR2, and a VH CDR3 having an amino acid sequence of SEQ ID NOs:1181, 1182, and 1183, respectively, and (ii) a VL comprising a VL CDR1, VL CDR2, and VL CDR3 having an amino acid sequence of SEQ ID NOs:1184, 1185, and 1186, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and (ii) a VL comprising a VL CDR1, a VL CDR2, and a VL CDR3 having an amino acid sequence of a VL CDR1, a VL CDR2, and a VL CDR3, respectively, of SEQ ID NO:1188. In one aspect, provided herein is an antibody that binds TRGV9, comprising a VH having an amino acid sequence of SEQ ID NO:1187. In one aspect, provided herein is an antibody that binds TRGV9, comprising a VL having an amino acid sequence of SEQ ID NO:1188. In one aspect, provided herein is an antibody that binds TRGV9, comprising a VH having an amino acid sequence of SEQ ID NO:1187, and a VL having an amino acid sequence of SEQ ID NO:1188. In one aspect, provided herein is an antibody that binds TRGV9, comprising a heavy chain having an amino acid sequence of SEQ ID NO:1189. In one aspect, provided herein is an antibody that binds TRGV9, comprising a light chain having an amino acid sequence of SEQ ID NO:1190. In one aspect, provided herein is an antibody that binds TRGV9, comprising a heavy chain having an amino acid sequence of SEQ ID NO:1189, and a light chain having an amino acid sequence of SEQ ID NO:1190. In one aspect, provided herein is an antibody that binds TRGV9, comprising a VH having an amino acid sequence having at least 95% identity to an amino acid sequence of SEQ ID NO:1187. In one aspect, provided herein is an antibody that binds TRGV9, comprising a VL having an amino acid sequence having at least 95% identity to an amino acid sequence of SEQ ID NO:1188. In one aspect, provided herein is an antibody that binds TRGV9, comprising a VH having an amino acid sequence having at least 95% identity to an amino acid sequence of SEQ ID NO:1187, and a VL having an amino acid sequence having at least 95% identity to an amino acid sequence of SEQ ID NO:1188. In one aspect, provided herein is an antibody that binds TRGV9, comprising a heavy chain having an amino acid sequence having at least 95% identity to an amino acid sequence of SEQ ID NO:1189. In one aspect, provided herein is an antibody that binds TRGV9, comprising a light chain having an amino acid sequence having at least 95% identity to an amino acid sequence of SEQ ID NO:1190. In one aspect, provided herein is an antibody that binds TRGV9, comprising a heavy chain having an amino acid sequence having at least 95% identity to an amino acid sequence of SEQ ID NO:1189, and a light chain having an amino acid sequence having at least 95% identity to an amino acid sequence of SEQ ID NO:1190.

In one aspect, provided herein is an antibody that binds TRGV9, comprising: (i) a VH comprising a VH CDR1, a VH CDR2, and a VH CDR3 having an amino acid sequence of SEQ ID NOs:1191, 1192, and 1193, respectively, and (ii) a VL comprising a VL CDR1, VL CDR2, and VL CDR3 having an amino acid sequence of SEQ ID NOs:1194, 1195, and 1196, respectively. In one aspect, provided herein is an antibody that binds TRGV9, comprising: (i) a VH comprising a VH CDR1, a VH CDR2, and a VH CDR3 having an amino acid sequence of SEQ ID NOs:1197, 1198, and 1199, respectively, and (ii) a VL comprising a VL CDR1, VL CDR2, and VL CDR3 having an amino acid sequence of SEQ ID NOs:1200, 1201, and 1202, respectively. In one aspect, provided herein is an antibody that binds TRGV9, comprising: (i) a VH comprising a VH CDR1, a VH CDR2, and a VH CDR3 having an amino acid sequence of SEQ ID NOs:1203, 1204, and 1205, respectively, and (ii) a VL comprising a VL CDR1, VL CDR2, and VL CDR3 having an amino acid sequence of SEQ ID NOs:1206, 1207, and 1208, respectively. In one aspect, provided herein is an antibody that binds TRGV9, comprising: (i) a VH comprising a VH CDR1, a VH CDR2, and a VH CDR3 having an amino acid sequence of SEQ ID NOs:1209, 1210, and 1211, respectively, and (ii) a VL comprising a VL CDR1, VL CDR2, and VL CDR3 having an amino acid sequence of SEQ ID NOs:1212, 1213, and 1214, respectively. In one aspect, provided herein is an antibody that binds TRGV9, comprising: (i) a VH comprising a VH CDR1, a VH CDR2, and a VH CDR3 having an amino acid sequence of SEQ ID NOs:1215, 1216, and 1217, respectively, and (ii) a VL comprising a VL CDR1, VL CDR2, and VL CDR3 having an amino acid sequence of SEQ ID NOs:1218, 1219, and 1220, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and (ii) a VL comprising a VL CDR1, a VL CDR2, and a VL CDR3 having an amino acid sequence of a VL CDR1, a VL CDR2, and a VL CDR3, respectively, of SEQ ID NO:1222. In one aspect, provided herein is an antibody that binds TRGV9, comprising a VH having an amino acid sequence of SEQ ID NO:1221. In one aspect, provided herein is an antibody that binds TRGV9, comprising a VL having an amino acid sequence of SEQ ID NO:1222. In one aspect, provided herein is an antibody that binds TRGV9, comprising a VH having an amino acid sequence of SEQ ID NO:1221, and a VL having an amino acid sequence of SEQ ID NO:1222. In one aspect, provided herein is an antibody that binds TRGV9, comprising a heavy chain having an amino acid sequence of SEQ ID NO:1223. In one aspect, provided herein is an antibody that binds TRGV9, comprising a light chain having an amino acid sequence of SEQ ID NO:1224. In one aspect, provided herein is an antibody that binds TRGV9, comprising a heavy chain having an amino acid sequence of SEQ ID NO:1223, and a light chain having an amino acid sequence of SEQ ID NO:1224. In one aspect, provided herein is an antibody that binds TRGV9, comprising a VH having an amino acid sequence having at least 95% identity to an amino acid sequence of SEQ ID NO:1221. In one aspect, provided herein is an antibody that binds TRGV9, comprising a VL having an amino acid sequence having at least 95% identity to an amino acid sequence of SEQ ID NO:1222. In one aspect, provided herein is an antibody that binds TRGV9, comprising a VH having an amino acid sequence having at least 95% identity to an amino acid sequence of SEQ ID NO:1221, and a VL having an amino acid sequence having at least 95% identity to an amino acid sequence of SEQ ID NO:1222. In one aspect, provided herein is an antibody that binds TRGV9, comprising a heavy chain having an amino acid sequence having at least 95% identity to an amino acid sequence of SEQ ID NO:1223. In one aspect, provided herein is an antibody that binds TRGV9, comprising a light chain having an amino acid sequence having at least 95% identity to an amino acid sequence of SEQ ID NO:1224. In one aspect, provided herein is an antibody that binds TRGV9, comprising a heavy chain having an amino acid sequence having at least 95% identity to an amino acid sequence of SEQ ID NO:1223, and a light chain having an amino acid sequence having at least 95% identity to an amino acid sequence of SEQ ID NO:1224.

In one aspect, provided herein is an antibody that binds TRGV9, comprising: (i) a VH comprising a VH CDR1, a VH CDR2, and a VH CDR3 having an amino acid sequence of SEQ ID NOs:1225, 1226, and 1227, respectively, and (ii) a VL comprising a VL CDR1, VL CDR2, and VL CDR3 having an amino acid sequence of SEQ ID NOs:1228, 1229, and 1230, respectively. In one aspect, provided herein is an antibody that binds TRGV9, comprising: (i) a VH comprising a VH CDR1, a VH CDR2, and a VH CDR3 having an amino acid sequence of SEQ ID NOs:1231, 1232, and 1233, respectively, and (ii) a VL comprising a VL CDR1, VL CDR2, and VL CDR3 having an amino acid sequence of SEQ ID NOs:1234, 1235, and 1236, respectively. In one aspect, provided herein is an antibody that binds TRGV9, comprising: (i) a VH comprising a VH CDR1, a VH CDR2, and a VH CDR3 having an amino acid sequence of SEQ ID NOs:1237, 1238, and 1239, respectively, and (ii) a VL comprising a VL CDR1, VL CDR2, and VL CDR3 having an amino acid sequence of SEQ ID NOs:1240, 1241, and 1242, respectively. In one aspect, provided herein is an antibody that binds TRGV9, comprising: (i) a VH comprising a VH CDR1, a VH CDR2, and a VH CDR3 having an amino acid sequence of SEQ ID NOs:1243, 1244, and 1245, respectively, and (ii) a VL comprising a VL CDR1, VL CDR2, and VL CDR3 having an amino acid sequence of SEQ ID NOs:1246, 1247, and 1248, respectively. In one aspect, provided herein is an antibody that binds TRGV9, comprising: (i) a VH comprising a VH CDR1, a VH CDR2, and a VH CDR3 having an amino acid sequence of SEQ ID NOs:1249, 1250, and 1251, respectively, and (ii) a VL comprising a VL CDR1, VL CDR2, and VL CDR3 having an amino acid sequence of SEQ ID NOs:1252, 1253, and 1254, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and (ii) a VL comprising a VL CDR1, a VL CDR2, and a VL CDR3 having an amino acid sequence of a VL CDR1, a VL CDR2, and a VL CDR3, respectively, of SEQ ID NO:1256. In one aspect, provided herein is an antibody that binds TRGV9, comprising a VH having an amino acid sequence of SEQ ID NO:1255. In one aspect, provided herein is an antibody that binds TRGV9, comprising a VL having an amino acid sequence of SEQ ID NO:1256. In one aspect, provided herein is an antibody that binds TRGV9, comprising a VH having an amino acid sequence of SEQ ID NO:1255, and a VL having an amino acid sequence of SEQ ID NO:1256. In one aspect, provided herein is an antibody that binds TRGV9, comprising a heavy chain having an amino acid sequence of SEQ ID NO:1257. In one aspect, provided herein is an antibody that binds TRGV9, comprising a light chain having an amino acid sequence of SEQ ID NO:1258. In one aspect, provided herein is an antibody that binds TRGV9, comprising a heavy chain having an amino acid sequence of SEQ ID NO:1257, and a light chain having an amino acid sequence of SEQ ID NO:1258. In one aspect, provided herein is an antibody that binds TRGV9, comprising a VH having an amino acid sequence having at least 95% identity to an amino acid sequence of SEQ ID NO:1255. In one aspect, provided herein is an antibody that binds TRGV9, comprising a VL having an amino acid sequence having at least 95% identity to an amino acid sequence of SEQ ID NO:1256. In one aspect, provided herein is an antibody that binds TRGV9, comprising a VH having an amino acid sequence having at least 95% identity to an amino acid sequence of SEQ ID NO:1255, and a VL having an amino acid sequence having at least 95% identity to an amino acid sequence of SEQ ID NO:1256. In one aspect, provided herein is an antibody that binds TRGV9, comprising a heavy chain having an amino acid sequence having at least 95% identity to an amino acid sequence of SEQ ID NO:1257. In one aspect, provided herein is an antibody that binds TRGV9, comprising a light chain having an amino acid sequence having at least 95% identity to an amino acid sequence of SEQ ID NO:1258. In one aspect, provided herein is an antibody that binds TRGV9, comprising a heavy chain having an amino acid sequence having at least 95% identity to an amino acid sequence of SEQ ID NO:1257, and a light chain having an amino acid sequence having at least 95% identity to an amino acid sequence of SEQ ID NO:1258.

In one aspect, provided herein is an antibody that binds TRGV9, comprising: (i) a VH comprising a VH CDR1, a VH CDR2, and a VH CDR3 having an amino acid sequence of SEQ ID NOs:1259, 1260, and 1261, respectively, and (ii) a VL comprising a VL CDR1, VL CDR2, and VL CDR3 having an amino acid sequence of SEQ ID NOs:1262, 1263, and 1264, respectively. In one aspect, provided herein is an antibody that binds TRGV9, comprising: (i) a VH comprising a VH CDR1, a VH CDR2, and a VH CDR3 having an amino acid sequence of SEQ ID NOs:1265, 1266, and 1267, respectively, and (ii) a VL comprising a VL CDR1, VL CDR2, and VL CDR3 having an amino acid sequence of SEQ ID NOs:1268, 1269, and 1270, respectively. In one aspect, provided herein is an antibody that binds TRGV9, comprising: (i) a VH comprising a VH CDR1, a VH CDR2, and a VH CDR3 having an amino acid sequence of SEQ ID NOs:1271, 1272, and 1273, respectively, and (ii) a VL comprising a VL CDR1, VL CDR2, and VL CDR3 having an amino acid sequence of SEQ ID NOs:1274, 1275, and 1276, respectively. In one aspect, provided herein is an antibody that binds TRGV9, comprising: (i) a VH comprising a VH CDR1, a VH CDR2, and a VH CDR3 having an amino acid sequence of SEQ ID NOs:1277, 1278, and 1279, respectively, and (ii) a VL comprising a VL CDR1, VL CDR2, and VL CDR3 having an amino acid sequence of SEQ ID NOs:1280, 1281, and 1282, respectively. In one aspect, provided herein is an antibody that binds TRGV9, comprising: (i) a VH comprising a VH CDR1, a VH CDR2, and a VH CDR3 having an amino acid sequence of SEQ ID NOs:1283, 1284, and 1285, respectively, and (ii) a VL comprising a VL CDR1, VL CDR2, and VL CDR3 having an amino acid sequence of SEQ ID NOs:1286, 1287, and 1288, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and (ii) a VL comprising a VL CDR1, a VL CDR2, and a VL CDR3 having an amino acid sequence of a VL CDR1, a VL CDR2, and a VL CDR3, respectively, of SEQ ID NO:1290. In one aspect, provided herein is an antibody that binds TRGV9, comprising a VH having an amino acid sequence of SEQ ID NO:1289. In one aspect, provided herein is an antibody that binds TRGV9, comprising a VL having an amino acid sequence of SEQ ID NO:1290. In one aspect, provided herein is an antibody that binds TRGV9, comprising a VH having an amino acid sequence of SEQ ID NO:1289, and a VL having an amino acid sequence of SEQ ID NO:1290. In one aspect, provided herein is an antibody that binds TRGV9, comprising a heavy chain having an amino acid sequence of SEQ ID NO:1291. In one aspect, provided herein is an antibody that binds TRGV9, comprising a light chain having an amino acid sequence of SEQ ID NO:1292. In one aspect, provided herein is an antibody that binds TRGV9, comprising a heavy chain having an amino acid sequence of SEQ ID NO:1291, and a light chain having an amino acid sequence of SEQ ID NO:1292. In one aspect, provided herein is an antibody that binds TRGV9, comprising a VH having an amino acid sequence having at least 95% identity to an amino acid sequence of SEQ ID NO:1289. In one aspect, provided herein is an antibody that binds TRGV9, comprising a VL having an amino acid sequence having at least 95% identity to an amino acid sequence of SEQ ID NO:1290. In one aspect, provided herein is an antibody that binds TRGV9, comprising a VH having an amino acid sequence having at least 95% identity to an amino acid sequence of SEQ ID NO:1289, and a VL having an amino acid sequence having at least 95% identity to an amino acid sequence of SEQ ID NO:1290. In one aspect, provided herein is an antibody that binds TRGV9, comprising a heavy chain having an amino acid sequence having at least 95% identity to an amino acid sequence of SEQ ID NO:1291. In one aspect, provided herein is an antibody that binds TRGV9, comprising a light chain having an amino acid sequence having at least 95% identity to an amino acid sequence of SEQ ID NO:1292. In one aspect, provided herein is an antibody that binds TRGV9, comprising a heavy chain having an amino acid sequence having at least 95% identity to an amino acid sequence of SEQ ID NO:1291, and a light chain having an amino acid sequence having at least 95% identity to an amino acid sequence of SEQ ID NO:1292.

In one aspect, provided herein is an antibody that binds TRGV9, comprising: (i) a VH comprising a VH CDR1, a VH CDR2, and a VH CDR3 having an amino acid sequence of SEQ ID NOs:1293, 1294, and 1295, respectively, and (ii) a VL comprising a VL CDR1, VL CDR2, and VL CDR3 having an amino acid sequence of SEQ ID NOs:1296, 1297, and 1298, respectively. In one aspect, provided herein is an antibody that binds TRGV9, comprising: (i) a VH comprising a VH CDR1, a VH CDR2, and a VH CDR3 having an amino acid sequence of SEQ ID NOs:1299, 1300, and 1301, respectively, and (ii) a VL comprising a VL CDR1, VL CDR2, and VL CDR3 having an amino acid sequence of SEQ ID NOs:1302, 1303, and 1304, respectively. In one aspect, provided herein is an antibody that binds TRGV9, comprising: (i) a VH comprising a VH CDR1, a VH CDR2, and a VH CDR3 having an amino acid sequence of SEQ ID NOs:1305, 1306, and 1307, respectively, and (ii) a VL comprising a VL CDR1, VL CDR2, and VL CDR3 having an amino acid sequence of SEQ ID NOs:1308, 1309, and 1310, respectively. In one aspect, provided herein is an antibody that binds TRGV9, comprising: (i) a VH comprising a VH CDR1, a VH CDR2, and a VH CDR3 having an amino acid sequence of SEQ ID NOs:1311, 1312, and 1313, respectively, and (ii) a VL comprising a VL CDR1, VL CDR2, and VL CDR3 having an amino acid sequence of SEQ ID NOs:1314, 1315, and 1316, respectively. In one aspect, provided herein is an antibody that binds TRGV9, comprising: (i) a VH comprising a VH CDR1, a VH CDR2, and a VH CDR3 having an amino acid sequence of SEQ ID NOs:1317, 1318, and 1319, respectively, and (ii) a VL comprising a VL CDR1, VL CDR2, and VL CDR3 having an amino acid sequence of SEQ ID NOs:1320, 1321, and 1322, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and (ii) a VL comprising a VL CDR1, a VL CDR2, and a VL CDR3 having an amino acid sequence of a VL CDR1, a VL CDR2, and a VL CDR3, respectively, of SEQ ID NO:1324. In one aspect, provided herein is an antibody that binds TRGV9, comprising a VH having an amino acid sequence of SEQ ID NO:1323. In one aspect, provided herein is an antibody that binds TRGV9, comprising a VL having an amino acid sequence of SEQ ID NO:1324. In one aspect, provided herein is an antibody that binds TRGV9, comprising a VH having an amino acid sequence of SEQ ID NO:1323, and a VL having an amino acid sequence of SEQ ID NO:1324. In one aspect, provided herein is an antibody that binds TRGV9, comprising a heavy chain having an amino acid sequence of SEQ ID NO:1325. In one aspect, provided herein is an antibody that binds TRGV9, comprising a light chain having an amino acid sequence of SEQ ID NO:1326. In one aspect, provided herein is an antibody that binds TRGV9, comprising a heavy chain having an amino acid sequence of SEQ ID NO:1325, and a light chain having an amino acid sequence of SEQ ID NO:1326. In one aspect, provided herein is an antibody that binds TRGV9, comprising a VH having an amino acid sequence having at least 95% identity to an amino acid sequence of SEQ ID NO:1323. In one aspect, provided herein is an antibody that binds TRGV9, comprising a VL having an amino acid sequence having at least 95% identity to an amino acid sequence of SEQ ID NO:1324. In one aspect, provided herein is an antibody that binds TRGV9, comprising a VH having an amino acid sequence having at least 95% identity to an amino acid sequence of SEQ ID NO:1323, and a VL having an amino acid sequence having at least 95% identity to an amino acid sequence of SEQ ID NO:1324. In one aspect, provided herein is an antibody that binds TRGV9, comprising a heavy chain having an amino acid sequence having at least 95% identity to an amino acid sequence of SEQ ID NO:1325. In one aspect, provided herein is an antibody that binds TRGV9, comprising a light chain having an amino acid sequence having at least 95% identity to an amino acid sequence of SEQ ID NO:1326. In one aspect, provided herein is an antibody that binds TRGV9, comprising a heavy chain having an amino acid sequence having at least 95% identity to an amino acid sequence of SEQ ID NO:1325, and a light chain having an amino acid sequence having at least 95% identity to an amino acid sequence of SEQ ID NO:1326.

In one aspect, provided herein is an antibody that binds TRGV9, comprising: (i) a VH comprising a VH CDR1, a VH CDR2, and a VH CDR3 having an amino acid sequence of SEQ ID NOs:1327, 1328, and 1329, respectively, and (ii) a VL comprising a VL CDR1, VL CDR2, and VL CDR3 having an amino acid sequence of SEQ ID NOs:1330, 1331, and 1332, respectively. In one aspect, provided herein is an antibody that binds TRGV9, comprising: (i) a VH comprising a VH CDR1, a VH CDR2, and a VH CDR3 having an amino acid sequence of SEQ ID NOs:1333, 1334, and 1335, respectively, and (ii) a VL comprising a VL CDR1, VL CDR2, and VL CDR3 having an amino acid sequence of SEQ ID NOs:1336, 1337, and 1338, respectively. In one aspect, provided herein is an antibody that binds TRGV9, comprising: (i) a VH comprising a VH CDR1, a VH CDR2, and a VH CDR3 having an amino acid sequence of SEQ ID NOs:1339, 1340, and 1341, respectively, and (ii) a VL comprising a VL CDR1, VL CDR2, and VL CDR3 having an amino acid sequence of SEQ ID NOs:1342, 1343, and 1344, respectively. In one aspect, provided herein is an antibody that binds TRGV9, comprising: (i) a VH comprising a VH CDR1, a VH CDR2, and a VH CDR3 having an amino acid sequence of SEQ ID NOs:1345, 1346, and 1347, respectively, and (ii) a VL comprising a VL CDR1, VL CDR2, and VL CDR3 having an amino acid sequence of SEQ ID NOs:1348, 1349, and 1350, respectively. In one aspect, provided herein is an antibody that binds TRGV9, comprising: (i) a VH comprising a VH CDR1, a VH CDR2, and a VH CDR3 having an amino acid sequence of SEQ ID NOs:1351, 1352, and 1353, respectively, and (ii) a VL comprising a VL CDR1, VL CDR2, and VL CDR3 having an amino acid sequence of SEQ ID NOs:1354, 1355, and 1356, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and (ii) a VL comprising a VL CDR1, a VL CDR2, and a VL CDR3 having an amino acid sequence of a VL CDR1, a VL CDR2, and a VL CDR3, respectively, of SEQ ID NO:1358. In one aspect, provided herein is an antibody that binds TRGV9, comprising a VH having an amino acid sequence of SEQ ID NO:1357. In one aspect, provided herein is an antibody that binds TRGV9, comprising a VL having an amino acid sequence of SEQ ID NO:1358. In one aspect, provided herein is an antibody that binds TRGV9, comprising a VH having an amino acid sequence of SEQ ID NO:1357, and a VL having an amino acid sequence of SEQ ID NO:1358. In one aspect, provided herein is an antibody that binds TRGV9, comprising a heavy chain having an amino acid sequence of SEQ ID NO:1359. In one aspect, provided herein is an antibody that binds TRGV9, comprising a light chain having an amino acid sequence of SEQ ID NO:1360. In one aspect, provided herein is an antibody that binds TRGV9, comprising a heavy chain having an amino acid sequence of SEQ ID NO:1359, and a light chain having an amino acid sequence of SEQ ID NO:1360. In one aspect, provided herein is an antibody that binds TRGV9, comprising a VH having an amino acid sequence having at least 95% identity to an amino acid sequence of SEQ ID NO:1357. In one aspect, provided herein is an antibody that binds TRGV9, comprising a VL having an amino acid sequence having at least 95% identity to an amino acid sequence of SEQ ID NO:1358. In one aspect, provided herein is an antibody that binds TRGV9, comprising a VH having an amino acid sequence having at least 95% identity to an amino acid sequence of SEQ ID NO:1357, and a VL having an amino acid sequence having at least 95% identity to an amino acid sequence of SEQ ID NO:1358. In one aspect, provided herein is an antibody that binds TRGV9, comprising a heavy chain having an amino acid sequence having at least 95% identity to an amino acid sequence of SEQ ID NO:1359. In one aspect, provided herein is an antibody that binds TRGV9, comprising a light chain having an amino acid sequence having at least 95% identity to an amino acid sequence of SEQ ID NO:1360. In one aspect, provided herein is an antibody that binds TRGV9, comprising a heavy chain having an amino acid sequence having at least 95% identity to an amino acid sequence of SEQ ID NO:1359, and a light chain having an amino acid sequence having at least 95% identity to an amino acid sequence of SEQ ID NO:1360.

In one aspect, provided herein is an antibody that binds TRGV9, comprising: (i) a VH comprising a VH CDR1, a VH CDR2, and a VH CDR3 having an amino acid sequence of SEQ ID NOs:1361, 1362, and 1363, respectively, and (ii) a VL comprising a VL CDR1, VL CDR2, and VL CDR3 having an amino acid sequence of SEQ ID NOs:1364, 1365, and 1366, respectively. In one aspect, provided herein is an antibody that binds TRGV9, comprising: (i) a VH comprising a VH CDR1, a VH CDR2, and a VH CDR3 having an amino acid sequence of SEQ ID NOs:1367, 1368, and 1369, respectively, and (ii) a VL comprising a VL CDR1, VL CDR2, and VL CDR3 having an amino acid sequence of SEQ ID NOs:1370, 1371, and 1372, respectively. In one aspect, provided herein is an antibody that binds TRGV9, comprising: (i) a VH comprising a VH CDR1, a VH CDR2, and a VH CDR3 having an amino acid sequence of SEQ ID NOs:1373, 1374, and 1375, respectively, and (ii) a VL comprising a VL CDR1, VL CDR2, and VL CDR3 having an amino acid sequence of SEQ ID NOs:1376, 1377, and 1378, respectively. In one aspect, provided herein is an antibody that binds TRGV9, comprising: (i) a VH comprising a VH CDR1, a VH CDR2, and a VH CDR3 having an amino acid sequence of SEQ ID NOs:1379, 1380, and 1381, respectively, and (ii) a VL comprising a VL CDR1, VL CDR2, and VL CDR3 having an amino acid sequence of SEQ ID NOs:1382, 1383, and 1384, respectively. In one aspect, provided herein is an antibody that binds TRGV9, comprising: (i) a VH comprising a VH CDR1, a VH CDR2, and a VH CDR3 having an amino acid sequence of SEQ ID NOs:1385, 1386, and 1387, respectively, and (ii) a VL comprising a VL CDR1, VL CDR2, and VL CDR3 having an amino acid sequence of SEQ ID NOs:1388, 1389, and 1390, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and (ii) a VL comprising a VL CDR1, a VL CDR2, and a VL CDR3 having an amino acid sequence of a VL CDR1, a VL CDR2, and a VL CDR3, respectively, of SEQ ID NO:1392. In one aspect, provided herein is an antibody that binds TRGV9, comprising a VH having an amino acid sequence of SEQ ID NO:1391. In one aspect, provided herein is an antibody that binds TRGV9, comprising a VL having an amino acid sequence of SEQ ID NO:1392. In one aspect, provided herein is an antibody that binds TRGV9, comprising a VH having an amino acid sequence of SEQ ID NO:1391, and a VL having an amino acid sequence of SEQ ID NO:1392. In one aspect, provided herein is an antibody that binds TRGV9, comprising a heavy chain having an amino acid sequence of SEQ ID NO:1393. In one aspect, provided herein is an antibody that binds TRGV9, comprising a light chain having an amino acid sequence of SEQ ID NO:1394. In one aspect, provided herein is an antibody that binds TRGV9, comprising a heavy chain having an amino acid sequence of SEQ ID NO:1393, and a light chain having an amino acid sequence of SEQ ID NO:1394. In one aspect, provided herein is an antibody that binds TRGV9, comprising a VH having an amino acid sequence having at least 95% identity to an amino acid sequence of SEQ ID NO:1391. In one aspect, provided herein is an antibody that binds TRGV9, comprising a VL having an amino acid sequence having at least 95% identity to an amino acid sequence of SEQ ID NO:1392. In one aspect, provided herein is an antibody that binds TRGV9, comprising a VH having an amino acid sequence having at least 95% identity to an amino acid sequence of SEQ ID NO:1391, and a VL having an amino acid sequence having at least 95% identity to an amino acid sequence of SEQ ID NO:1392. In one aspect, provided herein is an antibody that binds TRGV9, comprising a heavy chain having an amino acid sequence having at least 95% identity to an amino acid sequence of SEQ ID NO:1393. In one aspect, provided herein is an antibody that binds TRGV9, comprising a light chain having an amino acid sequence having at least 95% identity to an amino acid sequence of SEQ ID NO:1394. In one aspect, provided herein is an antibody that binds TRGV9, comprising a heavy chain having an amino acid sequence having at least 95% identity to an amino acid sequence of SEQ ID NO:1393, and a light chain having an amino acid sequence having at least 95% identity to an amino acid sequence of SEQ ID NO:1394.

In one aspect, provided herein is an antibody that binds TRGV9, comprising: (i) a VH comprising a VH CDR1, a VH CDR2, and a VH CDR3 having an amino acid sequence of SEQ ID NOs:1395, 1396, and 1397, respectively, and (ii) a VL comprising a VL CDR1, VL CDR2, and VL CDR3 having an amino acid sequence of SEQ ID NOs:1398, 1399, and 1400, respectively. In one aspect, provided herein is an antibody that binds TRGV9, comprising: (i) a VH comprising a VH CDR1, a VH CDR2, and a VH CDR3 having an amino acid sequence of SEQ ID NOs:1401, 1402, and 1403, respectively, and (ii) a VL comprising a VL CDR1, VL CDR2, and VL CDR3 having an amino acid sequence of SEQ ID NOs:1404, 1405, and 1406, respectively. In one aspect, provided herein is an antibody that binds TRGV9, comprising: (i) a VH comprising a VH CDR1, a VH CDR2, and a VH CDR3 having an amino acid sequence of SEQ ID NOs:1407, 1408, and 1409, respectively, and (ii) a VL comprising a VL CDR1, VL CDR2, and VL CDR3 having an amino acid sequence of SEQ ID NOs:1410, 1411, and 1412, respectively. In one aspect, provided herein is an antibody that binds TRGV9, comprising: (i) a VH comprising a VH CDR1, a VH CDR2, and a VH CDR3 having an amino acid sequence of SEQ ID NOs:1413, 1414, and 1415, respectively, and (ii) a VL comprising a VL CDR1, VL CDR2, and VL CDR3 having an amino acid sequence of SEQ ID NOs:1416, 1417, and 1418, respectively. In one aspect, provided herein is an antibody that binds TRGV9, comprising: (i) a VH comprising a VH CDR1, a VH CDR2, and a VH CDR3 having an amino acid sequence of SEQ ID NOs:1419, 1420, and 1421, respectively, and (ii) a VL comprising a VL CDR1, VL CDR2, and VL CDR3 having an amino acid sequence of SEQ ID NOs:1422, 1423, and 1424, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425; and (ii) a VL comprising a VL CDR1, a VL CDR2, and a VL CDR3 having an amino acid sequence of a VL CDR1, a VL CDR2, and a VL CDR3, respectively, of SEQ ID NO:1426. In one aspect, provided herein is an antibody that binds TRGV9, comprising a VH having an amino acid sequence of SEQ ID NO:1425. In one aspect, provided herein is an antibody that binds TRGV9, comprising a VL having an amino acid sequence of SEQ ID NO:1426. In one aspect, provided herein is an antibody that binds TRGV9, comprising a VH having an amino acid sequence of SEQ ID NO:1425, and a VL having an amino acid sequence of SEQ ID NO:1426. In one aspect, provided herein is an antibody that binds TRGV9, comprising a heavy chain having an amino acid sequence of SEQ ID NO:1427. In one aspect, provided herein is an antibody that binds TRGV9, comprising a light chain having an amino acid sequence of SEQ ID NO:1428. In one aspect, provided herein is an antibody that binds TRGV9, comprising a heavy chain having an amino acid sequence of SEQ ID NO:1427, and a light chain having an amino acid sequence of SEQ ID NO:1428. In one aspect, provided herein is an antibody that binds TRGV9, comprising a VH having an amino acid sequence having at least 95% identity to an amino acid sequence of SEQ ID NO:1425. In one aspect, provided herein is an antibody that binds TRGV9, comprising a VL having an amino acid sequence having at least 95% identity to an amino acid sequence of SEQ ID NO:1426. In one aspect, provided herein is an antibody that binds TRGV9, comprising a VH having an amino acid sequence having at least 95% identity to an amino acid sequence of SEQ ID NO:1425, and a VL having an amino acid sequence having at least 95% identity to an amino acid sequence of SEQ ID NO:1426. In one aspect, provided herein is an antibody that binds TRGV9, comprising a heavy chain having an amino acid sequence having at least 95% identity to an amino acid sequence of SEQ ID NO:1427. In one aspect, provided herein is an antibody that binds TRGV9, comprising a light chain having an amino acid sequence having at least 95% identity to an amino acid sequence of SEQ ID NO:1428. In one aspect, provided herein is an antibody that binds TRGV9, comprising a heavy chain having an amino acid sequence having at least 95% identity to an amino acid sequence of SEQ ID NO:1427, and a light chain having an amino acid sequence having at least 95% identity to an amino acid sequence of SEQ ID NO:1428.

In one aspect, provided herein is an antibody that binds TRGV9, comprising: (i) a VH comprising a VH CDR1, a VH CDR2, and a VH CDR3 having an amino acid sequence of SEQ ID NOs:1429, 1430, and 1431, respectively, and (ii) a VL comprising a VL CDR1, VL CDR2, and VL CDR3 having an amino acid sequence of SEQ ID NOs:1432, 1433, and 1434, respectively. In one aspect, provided herein is an antibody that binds TRGV9, comprising: (i) a VH comprising a VH CDR1, a VH CDR2, and a VH CDR3 having an amino acid sequence of SEQ ID NOs:1435, 1436, and 1437, respectively, and (ii) a VL comprising a VL CDR1, VL CDR2, and VL CDR3 having an amino acid sequence of SEQ ID NOs:1438, 1439, and 1440, respectively. In one aspect, provided herein is an antibody that binds TRGV9, comprising: (i) a VH comprising a VH CDR1, a VH CDR2, and a VH CDR3 having an amino acid sequence of SEQ ID NOs:1441, 1442, and 1443, respectively, and (ii) a VL comprising a VL CDR1, VL CDR2, and VL CDR3 having an amino acid sequence of SEQ ID NOs:1444, 1445, and 1446, respectively. In one aspect, provided herein is an antibody that binds TRGV9, comprising: (i) a VH comprising a VH CDR1, a VH CDR2, and a VH CDR3 having an amino acid sequence of SEQ ID NOs:1447, 1448, and 1449, respectively, and (ii) a VL comprising a VL CDR1, VL CDR2, and VL CDR3 having an amino acid sequence of SEQ ID NOs:1450, 1451, and 1452, respectively. In one aspect, provided herein is an antibody that binds TRGV9, comprising: (i) a VH comprising a VH CDR1, a VH CDR2, and a VH CDR3 having an amino acid sequence of SEQ ID NOs:1453, 1454, and 1455, respectively, and (ii) a VL comprising a VL CDR1, VL CDR2, and VL CDR3 having an amino acid sequence of SEQ ID NOs:1456, 1457, and 1458, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and (ii) a VL comprising a VL CDR1, a VL CDR2, and a VL CDR3 having an amino acid sequence of a VL CDR1, a VL CDR2, and a VL CDR3, respectively, of SEQ ID NO:1460. In one aspect, provided herein is an antibody that binds TRGV9, comprising a VH having an amino acid sequence of SEQ ID NO:1459. In one aspect, provided herein is an antibody that binds TRGV9, comprising a VL having an amino acid sequence of SEQ ID NO:1460. In one aspect, provided herein is an antibody that binds TRGV9, comprising a VH having an amino acid sequence of SEQ ID NO:1459, and a VL having an amino acid sequence of SEQ ID NO:1460. In one aspect, provided herein is an antibody that binds TRGV9, comprising a heavy chain having an amino acid sequence of SEQ ID NO:1461. In one aspect, provided herein is an antibody that binds TRGV9, comprising a light chain having an amino acid sequence of SEQ ID NO:1462. In one aspect, provided herein is an antibody that binds TRGV9, comprising a heavy chain having an amino acid sequence of SEQ ID NO:1461, and a light chain having an amino acid sequence of SEQ ID NO:1462. In one aspect, provided herein is an antibody that binds TRGV9, comprising a VH having an amino acid sequence having at least 95% identity to an amino acid sequence of SEQ ID NO:1459. In one aspect, provided herein is an antibody that binds TRGV9, comprising a VL having an amino acid sequence having at least 95% identity to an amino acid sequence of SEQ ID NO:1460. In one aspect, provided herein is an antibody that binds TRGV9, comprising a VH having an amino acid sequence having at least 95% identity to an amino acid sequence of SEQ ID NO:1459, and a VL having an amino acid sequence having at least 95% identity to an amino acid sequence of SEQ ID NO:1460. In one aspect, provided herein is an antibody that binds TRGV9, comprising a heavy chain having an amino acid sequence having at least 95% identity to an amino acid sequence of SEQ ID NO:1461. In one aspect, provided herein is an antibody that binds TRGV9, comprising a light chain having an amino acid sequence having at least 95% identity to an amino acid sequence of SEQ ID NO:1462. In one aspect, provided herein is an antibody that binds TRGV9, comprising a heavy chain having an amino acid sequence having at least 95% identity to an amino acid sequence of SEQ ID NO:1461, and a light chain having an amino acid sequence having at least 95% identity to an amino acid sequence of SEQ ID NO:1462.

In one aspect, provided herein is an antibody that binds TRGV9, comprising: (i) a VH comprising a VH CDR1, a VH CDR2, and a VH CDR3 having an amino acid sequence of SEQ ID NOs:1463, 1464, and 1465, respectively, and (ii) a VL comprising a VL CDR1, VL CDR2, and VL CDR3 having an amino acid sequence of SEQ ID NOs:1466, 1467, and 1468, respectively. In one aspect, provided herein is an antibody that binds TRGV9, comprising: (i) a VH comprising a VH CDR1, a VH CDR2, and a VH CDR3 having an amino acid sequence of SEQ ID NOs:1469, 1470, and 1471, respectively, and (ii) a VL comprising a VL CDR1, VL CDR2, and VL CDR3 having an amino acid sequence of SEQ ID NOs:1472, 1473, and 1474, respectively. In one aspect, provided herein is an antibody that binds TRGV9, comprising: (i) a VH comprising a VH CDR1, a VH CDR2, and a VH CDR3 having an amino acid sequence of SEQ ID NOs:1475, 1476, and 1477, respectively, and (ii) a VL comprising a VL CDR1, VL CDR2, and VL CDR3 having an amino acid sequence of SEQ ID NOs:1478, 1479, and 1480, respectively. In one aspect, provided herein is an antibody that binds TRGV9, comprising: (i) a VH comprising a VH CDR1, a VH CDR2, and a VH CDR3 having an amino acid sequence of SEQ ID NOs:1481, 1482, and 1483, respectively, and (ii) a VL comprising a VL CDR1, VL CDR2, and VL CDR3 having an amino acid sequence of SEQ ID NOs:1484, 1485, and 1486, respectively. In one aspect, provided herein is an antibody that binds TRGV9, comprising: (i) a VH comprising a VH CDR1, a VH CDR2, and a VH CDR3 having an amino acid sequence of SEQ ID NOs:1487, 1488, and 1489, respectively, and (ii) a VL comprising a VL CDR1, VL CDR2, and VL CDR3 having an amino acid sequence of SEQ ID NOs:1490, 1491, and 1492, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and (ii) a VL comprising a VL CDR1, a VL CDR2, and a VL CDR3 having an amino acid sequence of a VL CDR1, a VL CDR2, and a VL CDR3, respectively, of SEQ ID NO:1494. In one aspect, provided herein is an antibody that binds TRGV9, comprising a VH having an amino acid sequence of SEQ ID NO:1493. In one aspect, provided herein is an antibody that binds TRGV9, comprising a VL having an amino acid sequence of SEQ ID NO:1494. In one aspect, provided herein is an antibody that binds TRGV9, comprising a VH having an amino acid sequence of SEQ ID NO:1493, and a VL having an amino acid sequence of SEQ ID NO:1494. In one aspect, provided herein is an antibody that binds TRGV9, comprising a heavy chain having an amino acid sequence of SEQ ID NO:1495. In one aspect, provided herein is an antibody that binds TRGV9, comprising a light chain having an amino acid sequence of SEQ ID NO:1496. In one aspect, provided herein is an antibody that binds TRGV9, comprising a heavy chain having an amino acid sequence of SEQ ID NO:1495, and a light chain having an amino acid sequence of SEQ ID NO:1496. In one aspect, provided herein is an antibody that binds TRGV9, comprising a VH having an amino acid sequence having at least 95% identity to an amino acid sequence of SEQ ID NO:1493. In one aspect, provided herein is an antibody that binds TRGV9, comprising a VL having an amino acid sequence having at least 95% identity to an amino acid sequence of SEQ ID NO:1494. In one aspect, provided herein is an antibody that binds TRGV9, comprising a VH having an amino acid sequence having at least 95% identity to an amino acid sequence of SEQ ID NO:1493, and a VL having an amino acid sequence having at least 95% identity to an amino acid sequence of SEQ ID NO:1494. In one aspect, provided herein is an antibody that binds TRGV9, comprising a heavy chain having an amino acid sequence having at least 95% identity to an amino acid sequence of SEQ ID NO:1495. In one aspect, provided herein is an antibody that binds TRGV9, comprising a light chain having an amino acid sequence having at least 95% identity to an amino acid sequence of SEQ ID NO:1496. In one aspect, provided herein is an antibody that binds TRGV9, comprising a heavy chain having an amino acid sequence having at least 95% identity to an amino acid sequence of SEQ ID NO:1495, and a light chain having an amino acid sequence having at least 95% identity to an amino acid sequence of SEQ ID NO:1496.

In one aspect, provided herein is an antibody that binds TRGV9, comprising: (i) a VH comprising a VH CDR1, a VH CDR2, and a VH CDR3 having an amino acid sequence of SEQ ID NOs:1497, 1498, and 1499, respectively, and (ii) a VL comprising a VL CDR1, VL CDR2, and VL CDR3 having an amino acid sequence of SEQ ID NOs:1500, 1501, and 1502, respectively. In one aspect, provided herein is an antibody that binds TRGV9, comprising: (i) a VH comprising a VH CDR1, a VH CDR2, and a VH CDR3 having an amino acid sequence of SEQ ID NOs:1503, 1504, and 1505, respectively, and (ii) a VL comprising a VL CDR1, VL CDR2, and VL CDR3 having an amino acid sequence of SEQ ID NOs:1506, 1507, and 1508, respectively. In one aspect, provided herein is an antibody that binds TRGV9, comprising: (i) a VH comprising a VH CDR1, a VH CDR2, and a VH CDR3 having an amino acid sequence of SEQ ID NOs:1509, 1510, and 1511, respectively, and (ii) a VL comprising a VL CDR1, VL CDR2, and VL CDR3 having an amino acid sequence of SEQ ID NOs:1512, 1513, and 1514, respectively. In one aspect, provided herein is an antibody that binds TRGV9, comprising: (i) a VH comprising a VH CDR1, a VH CDR2, and a VH CDR3 having an amino acid sequence of SEQ ID NOs:1515, 1516, and 1517, respectively, and (ii) a VL comprising a VL CDR1, VL CDR2, and VL CDR3 having an amino acid sequence of SEQ ID NOs:1518, 1519, and 1520, respectively. In one aspect, provided herein is an antibody that binds TRGV9, comprising: (i) a VH comprising a VH CDR1, a VH CDR2, and a VH CDR3 having an amino acid sequence of SEQ ID NOs:1521, 1522, and 1523, respectively, and (ii) a VL comprising a VL CDR1, VL CDR2, and VL CDR3 having an amino acid sequence of SEQ ID NOs:1524, 1525, and 1526, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and (ii) a VL comprising a VL CDR1, a VL CDR2, and a VL CDR3 having an amino acid sequence of a VL CDR1, a VL CDR2, and a VL CDR3, respectively, of SEQ ID NO:1528. In one aspect, provided herein is an antibody that binds TRGV9, comprising a VH having an amino acid sequence of SEQ ID NO:1527. In one aspect, provided herein is an antibody that binds TRGV9, comprising a VL having an amino acid sequence of SEQ ID NO:1528. In one aspect, provided herein is an antibody that binds TRGV9, comprising a VH having an amino acid sequence of SEQ ID NO:1527, and a VL having an amino acid sequence of SEQ ID NO:1528. In one aspect, provided herein is an antibody that binds TRGV9, comprising a heavy chain having an amino acid sequence of SEQ ID NO:1529. In one aspect, provided herein is an antibody that binds TRGV9, comprising a light chain having an amino acid sequence of SEQ ID NO:1530. In one aspect, provided herein is an antibody that binds TRGV9, comprising a heavy chain having an amino acid sequence of SEQ ID NO:1529, and a light chain having an amino acid sequence of SEQ ID NO:1530. In one aspect, provided herein is an antibody that binds TRGV9, comprising a VH having an amino acid sequence having at least 95% identity to an amino acid sequence of SEQ ID NO:1527. In one aspect, provided herein is an antibody that binds TRGV9, comprising a VL having an amino acid sequence having at least 95% identity to an amino acid sequence of SEQ ID NO:1528. In one aspect, provided herein is an antibody that binds TRGV9, comprising a VH having an amino acid sequence having at least 95% identity to an amino acid sequence of SEQ ID NO:1527, and a VL having an amino acid sequence having at least 95% identity to an amino acid sequence of SEQ ID NO:1528. In one aspect, provided herein is an antibody that binds TRGV9, comprising a heavy chain having an amino acid sequence having at least 95% identity to an amino acid sequence of SEQ ID NO:1529. In one aspect, provided herein is an antibody that binds TRGV9, comprising a light chain having an amino acid sequence having at least 95% identity to an amino acid sequence of SEQ ID NO:1530. In one aspect, provided herein is an antibody that binds TRGV9, comprising a heavy chain having an amino acid sequence having at least 95% identity to an amino acid sequence of SEQ ID NO:1529, and a light chain having an amino acid sequence having at least 95% identity to an amino acid sequence of SEQ ID NO:1530.

In one aspect, provided herein is an antibody that binds TRGV9, comprising: (i) a VH comprising a VH CDR1, a VH CDR2, and a VH CDR3 having an amino acid sequence of SEQ ID NOs:1531, 1532, and 1533, respectively, and (ii) a VL comprising a VL CDR1, VL CDR2, and VL CDR3 having an amino acid sequence of SEQ ID NOs:1534, 1535, and 1536, respectively. In one aspect, provided herein is an antibody that binds TRGV9, comprising: (i) a VH comprising a VH CDR1, a VH CDR2, and a VH CDR3 having an amino acid sequence of SEQ ID NOs:1537, 1538, and 1539, respectively, and (ii) a VL comprising a VL CDR1, VL CDR2, and VL CDR3 having an amino acid sequence of SEQ ID NOs:1540, 1541, and 1542, respectively. In one aspect, provided herein is an antibody that binds TRGV9, comprising: (i) a VH comprising a VH CDR1, a VH CDR2, and a VH CDR3 having an amino acid sequence of SEQ ID NOs:1543, 1544, and 1545, respectively, and (ii) a VL comprising a VL CDR1, VL CDR2, and VL CDR3 having an amino acid sequence of SEQ ID NOs:1546, 1547, and 1548, respectively. In one aspect, provided herein is an antibody that binds TRGV9, comprising: (i) a VH comprising a VH CDR1, a VH CDR2, and a VH CDR3 having an amino acid sequence of SEQ ID NOs:1549, 1550, and 1551, respectively, and (ii) a VL comprising a VL CDR1, VL CDR2, and VL CDR3 having an amino acid sequence of SEQ ID NOs:1552, 1553, and 1554, respectively. In one aspect, provided herein is an antibody that binds TRGV9, comprising: (i) a VH comprising a VH CDR1, a VH CDR2, and a VH CDR3 having an amino acid sequence of SEQ ID NOs:1555, 1556, and 1557, respectively, and (ii) a VL comprising a VL CDR1, VL CDR2, and VL CDR3 having an amino acid sequence of SEQ ID NOs:1558, 1559, and 1560, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and (ii) a VL comprising a VL CDR1, a VL CDR2, and a VL CDR3 having an amino acid sequence of a VL CDR1, a VL CDR2, and a VL CDR3, respectively, of SEQ ID NO:1562. In one aspect, provided herein is an antibody that binds TRGV9, comprising a VH having an amino acid sequence of SEQ ID NO:1561. In one aspect, provided herein is an antibody that binds TRGV9, comprising a VL having an amino acid sequence of SEQ ID NO:1562. In one aspect, provided herein is an antibody that binds TRGV9, comprising a VH having an amino acid sequence of SEQ ID NO:1561, and a VL having an amino acid sequence of SEQ ID NO:1562. In one aspect, provided herein is an antibody that binds TRGV9, comprising a heavy chain having an amino acid sequence of SEQ ID NO:1563. In one aspect, provided herein is an antibody that binds TRGV9, comprising a light chain having an amino acid sequence of SEQ ID NO:1564. In one aspect, provided herein is an antibody that binds TRGV9, comprising a heavy chain having an amino acid sequence of SEQ ID NO:1563, and a light chain having an amino acid sequence of SEQ ID NO:1564. In one aspect, provided herein is an antibody that binds TRGV9, comprising a VH having an amino acid sequence having at least 95% identity to an amino acid sequence of SEQ ID NO:1561. In one aspect, provided herein is an antibody that binds TRGV9, comprising a VL having an amino acid sequence having at least 95% identity to an amino acid sequence of SEQ ID NO:1562. In one aspect, provided herein is an antibody that binds TRGV9, comprising a VH having an amino acid sequence having at least 95% identity to an amino acid sequence of SEQ ID NO:1561, and a VL having an amino acid sequence having at least 95% identity to an amino acid sequence of SEQ ID NO:1562. In one aspect, provided herein is an antibody that binds TRGV9, comprising a heavy chain having an amino acid sequence having at least 95% identity to an amino acid sequence of SEQ ID NO:1563. In one aspect, provided herein is an antibody that binds TRGV9, comprising a light chain having an amino acid sequence having at least 95% identity to an amino acid sequence of SEQ ID NO:1564. In one aspect, provided herein is an antibody that binds TRGV9, comprising a heavy chain having an amino acid sequence having at least 95% identity to an amino acid sequence of SEQ ID NO:1563, and a light chain having an amino acid sequence having at least 95% identity to an amino acid sequence of SEQ ID NO:1564.

In one aspect, provided herein is an antibody that binds TRGV9, comprising: (i) a VH comprising a VH CDR1, a VH CDR2, and a VH CDR3 having an amino acid sequence of SEQ ID NOs:1565, 1566, and 1567, respectively, and (ii) a VL comprising a VL CDR1, VL CDR2, and VL CDR3 having an amino acid sequence of SEQ ID NOs:1568, 1569, and 1570, respectively. In one aspect, provided herein is an antibody that binds TRGV9, comprising: (i) a VH comprising a VH CDR1, a VH CDR2, and a VH CDR3 having an amino acid sequence of SEQ ID NOs:1571, 1572, and 1573, respectively, and (ii) a VL comprising a VL CDR1, VL CDR2, and VL CDR3 having an amino acid sequence of SEQ ID NOs:1574, 1575, and 1576, respectively. In one aspect, provided herein is an antibody that binds TRGV9, comprising: (i) a VH comprising a VH CDR1, a VH CDR2, and a VH CDR3 having an amino acid sequence of SEQ ID NOs:1577, 1578, and 1579, respectively, and (ii) a VL comprising a VL CDR1, VL CDR2, and VL CDR3 having an amino acid sequence of SEQ ID NOs:1580, 1581, and 1582, respectively. In one aspect, provided herein is an antibody that binds TRGV9, comprising: (i) a VH comprising a VH CDR1, a VH CDR2, and a VH CDR3 having an amino acid sequence of SEQ ID NOs:1583, 1584, and 1585, respectively, and (ii) a VL comprising a VL CDR1, VL CDR2, and VL CDR3 having an amino acid sequence of SEQ ID NOs:1586, 1587, and 1588, respectively. In one aspect, provided herein is an antibody that binds TRGV9, comprising: (i) a VH comprising a VH CDR1, a VH CDR2, and a VH CDR3 having an amino acid sequence of SEQ ID NOs:1589, 1590, and 1591, respectively, and (ii) a VL comprising a VL CDR1, VL CDR2, and VL CDR3 having an amino acid sequence of SEQ ID NOs:1592, 1593, and 1594, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and (ii) a VL comprising a VL CDR1, a VL CDR2, and a VL CDR3 having an amino acid sequence of a VL CDR1, a VL CDR2, and a VL CDR3, respectively, of SEQ ID NO:1596. In one aspect, provided herein is an antibody that binds TRGV9, comprising a VH having an amino acid sequence of SEQ ID NO:1595. In one aspect, provided herein is an antibody that binds TRGV9, comprising a VL having an amino acid sequence of SEQ ID NO:1596. In one aspect, provided herein is an antibody that binds TRGV9, comprising a VH having an amino acid sequence of SEQ ID NO:1595, and a VL having an amino acid sequence of SEQ ID NO:1596. In one aspect, provided herein is an antibody that binds TRGV9, comprising a heavy chain having an amino acid sequence of SEQ ID NO:1597. In one aspect, provided herein is an antibody that binds TRGV9, comprising a light chain having an amino acid sequence of SEQ ID NO:1598. In one aspect, provided herein is an antibody that binds TRGV9, comprising a heavy chain having an amino acid sequence of SEQ ID NO:1597, and a light chain having an amino acid sequence of SEQ ID NO:1598. In one aspect, provided herein is an antibody that binds TRGV9, comprising a VH having an amino acid sequence having at least 95% identity to an amino acid sequence of SEQ ID NO:1595. In one aspect, provided herein is an antibody that binds TRGV9, comprising a VL having an amino acid sequence having at least 95% identity to an amino acid sequence of SEQ ID NO:1596. In one aspect, provided herein is an antibody that binds TRGV9, comprising a VH having an amino acid sequence having at least 95% identity to an amino acid sequence of SEQ ID NO:1595, and a VL having an amino acid sequence having at least 95% identity to an amino acid sequence of SEQ ID NO:1596. In one aspect, provided herein is an antibody that binds TRGV9, comprising a heavy chain having an amino acid sequence having at least 95% identity to an amino acid sequence of SEQ ID NO:1597. In one aspect, provided herein is an antibody that binds TRGV9, comprising a light chain having an amino acid sequence having at least 95% identity to an amino acid sequence of SEQ ID NO:1598. In one aspect, provided herein is an antibody that binds TRGV9, comprising a heavy chain having an amino acid sequence having at least 95% identity to an amino acid sequence of SEQ ID NO:1597, and a light chain having an amino acid sequence having at least 95% identity to an amino acid sequence of SEQ ID NO:1598.

In one aspect, provided herein is an antibody that binds TRGV9, comprising: (i) a VH comprising a VH CDR1, a VH CDR2, and a VH CDR3 having an amino acid sequence of SEQ ID NOs:1599, 1600, and 1601, respectively, and (ii) a VL comprising a VL CDR1, VL CDR2, and VL CDR3 having an amino acid sequence of SEQ ID NOs:1602, 1603, and 1604, respectively. In one aspect, provided herein is an antibody that binds TRGV9, comprising: (i) a VH comprising a VH CDR1, a VH CDR2, and a VH CDR3 having an amino acid sequence of SEQ ID NOs:1605, 1606, and 1607, respectively, and (ii) a VL comprising a VL CDR1, VL CDR2, and VL CDR3 having an amino acid sequence of SEQ ID NOs:1608, 1609, and 1610, respectively. In one aspect, provided herein is an antibody that binds TRGV9, comprising: (i) a VH comprising a VH CDR1, a VH CDR2, and a VH CDR3 having an amino acid sequence of SEQ ID NOs:1611, 1612, and 1613, respectively, and (ii) a VL comprising a VL CDR1, VL CDR2, and VL CDR3 having an amino acid sequence of SEQ ID NOs:1614, 1615, and 1616, respectively. In one aspect, provided herein is an antibody that binds TRGV9, comprising: (i) a VH comprising a VH CDR1, a VH CDR2, and a VH CDR3 having an amino acid sequence of SEQ ID NOs:1617, 1618, and 1619, respectively, and (ii) a VL comprising a VL CDR1, VL CDR2, and VL CDR3 having an amino acid sequence of SEQ ID NOs:1620, 1621, and 1622, respectively. In one aspect, provided herein is an antibody that binds TRGV9, comprising: (i) a VH comprising a VH CDR1, a VH CDR2, and a VH CDR3 having an amino acid sequence of SEQ ID NOs:1623, 1624, and 1625, respectively, and (ii) a VL comprising a VL CDR1, VL CDR2, and VL CDR3 having an amino acid sequence of SEQ ID NOs:1626, 1627, and 1628, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and (ii) a VL comprising a VL CDR1, a VL CDR2, and a VL CDR3 having an amino acid sequence of a VL CDR1, a VL CDR2, and a VL CDR3, respectively, of SEQ ID NO:1630. In one aspect, provided herein is an antibody that binds TRGV9, comprising a VH having an amino acid sequence of SEQ ID NO:1629. In one aspect, provided herein is an antibody that binds TRGV9, comprising a VL having an amino acid sequence of SEQ ID NO:1630. In one aspect, provided herein is an antibody that binds TRGV9, comprising a VH having an amino acid sequence of SEQ ID NO:1629, and a VL having an amino acid sequence of SEQ ID NO:1630. In one aspect, provided herein is an antibody that binds TRGV9, comprising a heavy chain having an amino acid sequence of SEQ ID NO:1631. In one aspect, provided herein is an antibody that binds TRGV9, comprising a light chain having an amino acid sequence of SEQ ID NO:1632. In one aspect, provided herein is an antibody that binds TRGV9, comprising a heavy chain having an amino acid sequence of SEQ ID NO:1631, and a light chain having an amino acid sequence of SEQ ID NO:1632. In one aspect, provided herein is an antibody that binds TRGV9, comprising a VH having an amino acid sequence having at least 95% identity to an amino acid sequence of SEQ ID NO:1629. In one aspect, provided herein is an antibody that binds TRGV9, comprising a VL having an amino acid sequence having at least 95% identity to an amino acid sequence of SEQ ID NO:1630. In one aspect, provided herein is an antibody that binds TRGV9, comprising a VH having an amino acid sequence having at least 95% identity to an amino acid sequence of SEQ ID NO:1629, and a VL having an amino acid sequence having at least 95% identity to an amino acid sequence of SEQ ID NO:1630. In one aspect, provided herein is an antibody that binds TRGV9, comprising a heavy chain having an amino acid sequence having at least 95% identity to an amino acid sequence of SEQ ID NO:1631. In one aspect, provided herein is an antibody that binds TRGV9, comprising a light chain having an amino acid sequence having at least 95% identity to an amino acid sequence of SEQ ID NO:1632. In one aspect, provided herein is an antibody that binds TRGV9, comprising a heavy chain having an amino acid sequence having at least 95% identity to an amino acid sequence of SEQ ID NO:1631, and a light chain having an amino acid sequence having at least 95% identity to an amino acid sequence of SEQ ID NO:1632.

In one aspect, provided herein is an antibody that binds TRGV9, comprising: (i) a VH comprising a VH CDR1, a VH CDR2, and a VH CDR3 having an amino acid sequence of SEQ ID NOs:1633, 1634, and 1635, respectively, and (ii) a VL comprising a VL CDR1, VL CDR2, and VL CDR3 having an amino acid sequence of SEQ ID NOs:1636, 1637, and 1638, respectively. In one aspect, provided herein is an antibody that binds TRGV9, comprising: (i) a VH comprising a VH CDR1, a VH CDR2, and a VH CDR3 having an amino acid sequence of SEQ ID NOs:1639, 1640, and 1641, respectively, and (ii) a VL comprising a VL CDR1, VL CDR2, and VL CDR3 having an amino acid sequence of SEQ ID NOs:1642, 1643, and 1644, respectively. In one aspect, provided herein is an antibody that binds TRGV9, comprising: (i) a VH comprising a VH CDR1, a VH CDR2, and a VH CDR3 having an amino acid sequence of SEQ ID NOs:1645, 1646, and 1647, respectively, and (ii) a VL comprising a VL CDR1, VL CDR2, and VL CDR3 having an amino acid sequence of SEQ ID NOs:1648, 1649, and 1650, respectively. In one aspect, provided herein is an antibody that binds TRGV9, comprising: (i) a VH comprising a VH CDR1, a VH CDR2, and a VH CDR3 having an amino acid sequence of SEQ ID NOs:1651, 1652, and 1653, respectively, and (ii) a VL comprising a VL CDR1, VL CDR2, and VL CDR3 having an amino acid sequence of SEQ ID NOs:1654, 1655, and 1656, respectively. In one aspect, provided herein is an antibody that binds TRGV9, comprising: (i) a VH comprising a VH CDR1, a VH CDR2, and a VH CDR3 having an amino acid sequence of SEQ ID NOs:1657, 1658, and 1659, respectively, and (ii) a VL comprising a VL CDR1, VL CDR2, and VL CDR3 having an amino acid sequence of SEQ ID NOs:1660, 1661, and 1662, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and (ii) a VL comprising a VL CDR1, a VL CDR2, and a VL CDR3 having an amino acid sequence of a VL CDR1, a VL CDR2, and a VL CDR3, respectively, of SEQ ID NO:1664. In one aspect, provided herein is an antibody that binds TRGV9, comprising a VH having an amino acid sequence of SEQ ID NO:1663. In one aspect, provided herein is an antibody that binds TRGV9, comprising a VL having an amino acid sequence of SEQ ID NO:1664. In one aspect, provided herein is an antibody that binds TRGV9, comprising a VH having an amino acid sequence of SEQ ID NO:1663, and a VL having an amino acid sequence of SEQ ID NO:1664. In one aspect, provided herein is an antibody that binds TRGV9, comprising a heavy chain having an amino acid sequence of SEQ ID NO:1665. In one aspect, provided herein is an antibody that binds TRGV9, comprising a light chain having an amino acid sequence of SEQ ID NO:1666. In one aspect, provided herein is an antibody that binds TRGV9, comprising a heavy chain having an amino acid sequence of SEQ ID NO:1665, and a light chain having an amino acid sequence of SEQ ID NO:1666. In one aspect, provided herein is an antibody that binds TRGV9, comprising a VH having an amino acid sequence having at least 95% identity to an amino acid sequence of SEQ ID NO:1663. In one aspect, provided herein is an antibody that binds TRGV9, comprising a VL having an amino acid sequence having at least 95% identity to an amino acid sequence of SEQ ID NO:1664. In one aspect, provided herein is an antibody that binds TRGV9, comprising a VH having an amino acid sequence having at least 95% identity to an amino acid sequence of SEQ ID NO:1663, and a VL having an amino acid sequence having at least 95% identity to an amino acid sequence of SEQ ID NO:1664. In one aspect, provided herein is an antibody that binds TRGV9, comprising a heavy chain having an amino acid sequence having at least 95% identity to an amino acid sequence of SEQ ID NO:1665. In one aspect, provided herein is an antibody that binds TRGV9, comprising a light chain having an amino acid sequence having at least 95% identity to an amino acid sequence of SEQ ID NO:1666. In one aspect, provided herein is an antibody that binds TRGV9, comprising a heavy chain having an amino acid sequence having at least 95% identity to an amino acid sequence of SEQ ID NO:1665, and a light chain having an amino acid sequence having at least 95% identity to an amino acid sequence of SEQ ID NO:1666.

In one aspect, provided herein is an antibody that binds TRGV9, comprising: (i) a VH comprising a VH CDR1, a VH CDR2, and a VH CDR3 having an amino acid sequence of SEQ ID NOs:1667, 1668, and 1669, respectively, and (ii) a VL comprising a VL CDR1, VL CDR2, and VL CDR3 having an amino acid sequence of SEQ ID NOs:1670, 1671, and 1672, respectively. In one aspect, provided herein is an antibody that binds TRGV9, comprising: (i) a VH comprising a VH CDR1, a VH CDR2, and a VH CDR3 having an amino acid sequence of SEQ ID NOs:1673, 1674, and 1675, respectively, and (ii) a VL comprising a VL CDR1, VL CDR2, and VL CDR3 having an amino acid sequence of SEQ ID NOs:1676, 1677, and 1678, respectively. In one aspect, provided herein is an antibody that binds TRGV9, comprising: (i) a VH comprising a VH CDR1, a VH CDR2, and a VH CDR3 having an amino acid sequence of SEQ ID NOs:1679, 1680, and 1681, respectively, and (ii) a VL comprising a VL CDR1, VL CDR2, and VL CDR3 having an amino acid sequence of SEQ ID NOs:1682, 1683, and 1684, respectively. In one aspect, provided herein is an antibody that binds TRGV9, comprising: (i) a VH comprising a VH CDR1, a VH CDR2, and a VH CDR3 having an amino acid sequence of SEQ ID NOs:1685, 1686, and 1687, respectively, and (ii) a VL comprising a VL CDR1, VL CDR2, and VL CDR3 having an amino acid sequence of SEQ ID NOs:1688, 1689, and 1690, respectively. In one aspect, provided herein is an antibody that binds TRGV9, comprising: (i) a VH comprising a VH CDR1, a VH CDR2, and a VH CDR3 having an amino acid sequence of SEQ ID NOs:1691, 1692, and 1693, respectively, and (ii) a VL comprising a VL CDR1, VL CDR2, and VL CDR3 having an amino acid sequence of SEQ ID NOs:1694, 1695, and 1696, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and (ii) a VL comprising a VL CDR1, a VL CDR2, and a VL CDR3 having an amino acid sequence of a VL CDR1, a VL CDR2, and a VL CDR3, respectively, of SEQ ID NO:1698. In one aspect, provided herein is an antibody that binds TRGV9, comprising a VH having an amino acid sequence of SEQ ID NO:1697. In one aspect, provided herein is an antibody that binds TRGV9, comprising a VL having an amino acid sequence of SEQ ID NO:1698. In one aspect, provided herein is an antibody that binds TRGV9, comprising a VH having an amino acid sequence of SEQ ID NO:1697, and a VL having an amino acid sequence of SEQ ID NO:1698. In one aspect, provided herein is an antibody that binds TRGV9, comprising a heavy chain having an amino acid sequence of SEQ ID NO:1699. In one aspect, provided herein is an antibody that binds TRGV9, comprising a light chain having an amino acid sequence of SEQ ID NO:1700. In one aspect, provided herein is an antibody that binds TRGV9, comprising a heavy chain having an amino acid sequence of SEQ ID NO:1699, and a light chain having an amino acid sequence of SEQ ID NO:1700. In one aspect, provided herein is an antibody that binds TRGV9, comprising a VH having an amino acid sequence having at least 95% identity to an amino acid sequence of SEQ ID NO:1697. In one aspect, provided herein is an antibody that binds TRGV9, comprising a VL having an amino acid sequence having at least 95% identity to an amino acid sequence of SEQ ID NO:1698. In one aspect, provided herein is an antibody that binds TRGV9, comprising a VH having an amino acid sequence having at least 95% identity to an amino acid sequence of SEQ ID NO:1697, and a VL having an amino acid sequence having at least 95% identity to an amino acid sequence of SEQ ID NO:1698. In one aspect, provided herein is an antibody that binds TRGV9, comprising a heavy chain having an amino acid sequence having at least 95% identity to an amino acid sequence of SEQ ID NO:1699. In one aspect, provided herein is an antibody that binds TRGV9, comprising a light chain having an amino acid sequence having at least 95% identity to an amino acid sequence of SEQ ID NO:1700. In one aspect, provided herein is an antibody that binds TRGV9, comprising a heavy chain having an amino acid sequence having at least 95% identity to an amino acid sequence of SEQ ID NO:1699, and a light chain having an amino acid sequence having at least 95% identity to an amino acid sequence of SEQ ID NO:1700.

In one aspect, provided herein is an antibody that binds TRGV9, comprising: (i) a VH comprising a VH CDR1, a VH CDR2, and a VH CDR3 having an amino acid sequence of SEQ ID NOs:1701, 1702, and 1703, respectively, and (ii) a VL comprising a VL CDR1, VL CDR2, and VL CDR3 having an amino acid sequence of SEQ ID NOs:1704, 1705, and 1706, respectively. In one aspect, provided herein is an antibody that binds TRGV9, comprising: (i) a VH comprising a VH CDR1, a VH CDR2, and a VH CDR3 having an amino acid sequence of SEQ ID NOs:1707, 1708, and 1709, respectively, and (ii) a VL comprising a VL CDR1, VL CDR2, and VL CDR3 having an amino acid sequence of SEQ ID NOs:1710, 1711, and 1712, respectively. In one aspect, provided herein is an antibody that binds TRGV9, comprising: (i) a VH comprising a VH CDR1, a VH CDR2, and a VH CDR3 having an amino acid sequence of SEQ ID NOs:1713, 1714, and 1715, respectively, and (ii) a VL comprising a VL CDR1, VL CDR2, and VL CDR3 having an amino acid sequence of SEQ ID NOs:1716, 1717, and 1718, respectively. In one aspect, provided herein is an antibody that binds TRGV9, comprising: (i) a VH comprising a VH CDR1, a VH CDR2, and a VH CDR3 having an amino acid sequence of SEQ ID NOs:1719, 1720, and 1721, respectively, and (ii) a VL comprising a VL CDR1, VL CDR2, and VL CDR3 having an amino acid sequence of SEQ ID NOs:1722, 1723, and 1724, respectively. In one aspect, provided herein is an antibody that binds TRGV9, comprising: (i) a VH comprising a VH CDR1, a VH CDR2, and a VH CDR3 having an amino acid sequence of SEQ ID NOs:1725, 1726, and 1727, respectively, and (ii) a VL comprising a VL CDR1, VL CDR2, and VL CDR3 having an amino acid sequence of SEQ ID NOs:1728, 1729, and 1730, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and (ii) a VL comprising a VL CDR1, a VL CDR2, and a VL CDR3 having an amino acid sequence of a VL CDR1, a VL CDR2, and a VL CDR3, respectively, of SEQ ID NO:1732. In one aspect, provided herein is an antibody that binds TRGV9, comprising a VH having an amino acid sequence of SEQ ID NO:1731. In one aspect, provided herein is an antibody that binds TRGV9, comprising a VL having an amino acid sequence of SEQ ID NO:1732. In one aspect, provided herein is an antibody that binds TRGV9, comprising a VH having an amino acid sequence of SEQ ID NO:1731, and a VL having an amino acid sequence of SEQ ID NO:1732. In one aspect, provided herein is an antibody that binds TRGV9, comprising a heavy chain having an amino acid sequence of SEQ ID NO:1733. In one aspect, provided herein is an antibody that binds TRGV9, comprising a light chain having an amino acid sequence of SEQ ID NO:1734. In one aspect, provided herein is an antibody that binds TRGV9, comprising a heavy chain having an amino acid sequence of SEQ ID NO:1733, and a light chain having an amino acid sequence of SEQ ID NO:1734. In one aspect, provided herein is an antibody that binds TRGV9, comprising a VH having an amino acid sequence having at least 95% identity to an amino acid sequence of SEQ ID NO:1731. In one aspect, provided herein is an antibody that binds TRGV9, comprising a VL having an amino acid sequence having at least 95% identity to an amino acid sequence of SEQ ID NO:1732. In one aspect, provided herein is an antibody that binds TRGV9, comprising a VH having an amino acid sequence having at least 95% identity to an amino acid sequence of SEQ ID NO:1731, and a VL having an amino acid sequence having at least 95% identity to an amino acid sequence of SEQ ID NO:1732. In one aspect, provided herein is an antibody that binds TRGV9, comprising a heavy chain having an amino acid sequence having at least 95% identity to an amino acid sequence of SEQ ID NO:1733. In one aspect, provided herein is an antibody that binds TRGV9, comprising a light chain having an amino acid sequence having at least 95% identity to an amino acid sequence of SEQ ID NO:1734. In one aspect, provided herein is an antibody that binds TRGV9, comprising a heavy chain having an amino acid sequence having at least 95% identity to an amino acid sequence of SEQ ID NO:1733, and a light chain having an amino acid sequence having at least 95% identity to an amino acid sequence of SEQ ID NO:1734.

In one aspect, provided herein is an antibody that binds TRGV9, comprising: (i) a VH comprising a VH CDR1, a VH CDR2, and a VH CDR3 having an amino acid sequence of SEQ ID NOs:1735, 1736, and 1737, respectively, and (ii) a VL comprising a VL CDR1, VL CDR2, and VL CDR3 having an amino acid sequence of SEQ ID NOs:1738, 1739, and 1740, respectively. In one aspect, provided herein is an antibody that binds TRGV9, comprising: (i) a VH comprising a VH CDR1, a VH CDR2, and a VH CDR3 having an amino acid sequence of SEQ ID NOs:1741, 1742, and 1743, respectively, and (ii) a VL comprising a VL CDR1, VL CDR2, and VL CDR3 having an amino acid sequence of SEQ ID NOs:1744, 1745, and 1746, respectively. In one aspect, provided herein is an antibody that binds TRGV9, comprising: (i) a VH comprising a VH CDR1, a VH CDR2, and a VH CDR3 having an amino acid sequence of SEQ ID NOs:1747, 1748, and 1749, respectively, and (ii) a VL comprising a VL CDR1, VL CDR2, and VL CDR3 having an amino acid sequence of SEQ ID NOs:1750, 1751, and 1752, respectively. In one aspect, provided herein is an antibody that binds TRGV9, comprising: (i) a VH comprising a VH CDR1, a VH CDR2, and a VH CDR3 having an amino acid sequence of SEQ ID NOs:1753, 1754, and 1755, respectively, and (ii) a VL comprising a VL CDR1, VL CDR2, and VL CDR3 having an amino acid sequence of SEQ ID NOs:1756, 1757, and 1758, respectively. In one aspect, provided herein is an antibody that binds TRGV9, comprising: (i) a VH comprising a VH CDR1, a VH CDR2, and a VH CDR3 having an amino acid sequence of SEQ ID NOs:1759, 1760, and 1761, respectively, and (ii) a VL comprising a VL CDR1, VL CDR2, and VL CDR3 having an amino acid sequence of SEQ ID NOs:1762, 1763, and 1764, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and (ii) a VL comprising a VL CDR1, a VL CDR2, and a VL CDR3 having an amino acid sequence of a VL CDR1, a VL CDR2, and a VL CDR3, respectively, of SEQ ID NO:1766. In one aspect, provided herein is an antibody that binds TRGV9, comprising a VH having an amino acid sequence of SEQ ID NO:1765. In one aspect, provided herein is an antibody that binds TRGV9, comprising a VL having an amino acid sequence of SEQ ID NO:1766. In one aspect, provided herein is an antibody that binds TRGV9, comprising a VH having an amino acid sequence of SEQ ID NO:1765, and a VL having an amino acid sequence of SEQ ID NO:1766. In one aspect, provided herein is an antibody that binds TRGV9, comprising a heavy chain having an amino acid sequence of SEQ ID NO:1767. In one aspect, provided herein is an antibody that binds TRGV9, comprising a light chain having an amino acid sequence of SEQ ID NO:1768. In one aspect, provided herein is an antibody that binds TRGV9, comprising a heavy chain having an amino acid sequence of SEQ ID NO:1767, and a light chain having an amino acid sequence of SEQ ID NO:1768. In one aspect, provided herein is an antibody that binds TRGV9, comprising a VH having an amino acid sequence having at least 95% identity to an amino acid sequence of SEQ ID NO:1765. In one aspect, provided herein is an antibody that binds TRGV9, comprising a VL having an amino acid sequence having at least 95% identity to an amino acid sequence of SEQ ID NO:1766. In one aspect, provided herein is an antibody that binds TRGV9, comprising a VH having an amino acid sequence having at least 95% identity to an amino acid sequence of SEQ ID NO:1765, and a VL having an amino acid sequence having at least 95% identity to an amino acid sequence of SEQ ID NO:1766. In one aspect, provided herein is an antibody that binds TRGV9, comprising a heavy chain having an amino acid sequence having at least 95% identity to an amino acid sequence of SEQ ID NO:1767. In one aspect, provided herein is an antibody that binds TRGV9, comprising a light chain having an amino acid sequence having at least 95% identity to an amino acid sequence of SEQ ID NO:1768. In one aspect, provided herein is an antibody that binds TRGV9, comprising a heavy chain having an amino acid sequence having at least 95% identity to an amino acid sequence of SEQ ID NO:1767, and a light chain having an amino acid sequence having at least 95% identity to an amino acid sequence of SEQ ID NO:1768.

In one aspect, provided herein is an antibody that binds TRGV9, comprising: (i) a VH comprising a VH CDR1, a VH CDR2, and a VH CDR3 having an amino acid sequence of SEQ ID NOs:1769, 1770, and 1771, respectively, and (ii) a VL comprising a VL CDR1, VL CDR2, and VL CDR3 having an amino acid sequence of SEQ ID NOs:1772, 1773, and 1774, respectively. In one aspect, provided herein is an antibody that binds TRGV9, comprising: (i) a VH comprising a VH CDR1, a VH CDR2, and a VH CDR3 having an amino acid sequence of SEQ ID NOs:1775, 1776, and 1777, respectively, and (ii) a VL comprising a VL CDR1, VL CDR2, and VL CDR3 having an amino acid sequence of SEQ ID NOs:1778, 1779, and 1780, respectively. In one aspect, provided herein is an antibody that binds TRGV9, comprising: (i) a VH comprising a VH CDR1, a VH CDR2, and a VH CDR3 having an amino acid sequence of SEQ ID NOs:1781, 1782, and 1783, respectively, and (ii) a VL comprising a VL CDR1, VL CDR2, and VL CDR3 having an amino acid sequence of SEQ ID NOs:1784, 1785, and 1786, respectively. In one aspect, provided herein is an antibody that binds TRGV9, comprising: (i) a VH comprising a VH CDR1, a VH CDR2, and a VH CDR3 having an amino acid sequence of SEQ ID NOs:1787, 1788, and 1789, respectively, and (ii) a VL comprising a VL CDR1, VL CDR2, and VL CDR3 having an amino acid sequence of SEQ ID NOs:1790, 1791, and 1792, respectively. In one aspect, provided herein is an antibody that binds TRGV9, comprising: (i) a VH comprising a VH CDR1, a VH CDR2, and a VH CDR3 having an amino acid sequence of SEQ ID NOs:1793, 1794, and 1795, respectively, and (ii) a VL comprising a VL CDR1, VL CDR2, and VL CDR3 having an amino acid sequence of SEQ ID NOs:1796, 1797, and 1798, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and (ii) a VL comprising a VL CDR1, a VL CDR2, and a VL CDR3 having an amino acid sequence of a VL CDR1, a VL CDR2, and a VL CDR3, respectively, of SEQ ID NO:1800. In one aspect, provided herein is an antibody that binds TRGV9, comprising a VH having an amino acid sequence of SEQ ID NO:1799. In one aspect, provided herein is an antibody that binds TRGV9, comprising a VL having an amino acid sequence of SEQ ID NO:1800. In one aspect, provided herein is an antibody that binds TRGV9, comprising a VH having an amino acid sequence of SEQ ID NO:1799, and a VL having an amino acid sequence of SEQ ID NO:1800. In one aspect, provided herein is an antibody that binds TRGV9, comprising a heavy chain having an amino acid sequence of SEQ ID NO:1801. In one aspect, provided herein is an antibody that binds TRGV9, comprising a light chain having an amino acid sequence of SEQ ID NO:1802. In one aspect, provided herein is an antibody that binds TRGV9, comprising a heavy chain having an amino acid sequence of SEQ ID NO:1801, and a light chain having an amino acid sequence of SEQ ID NO:1802. In one aspect, provided herein is an antibody that binds TRGV9, comprising a VH having an amino acid sequence having at least 95% identity to an amino acid sequence of SEQ ID NO:1799. In one aspect, provided herein is an antibody that binds TRGV9, comprising a VL having an amino acid sequence having at least 95% identity to an amino acid sequence of SEQ ID NO:1800. In one aspect, provided herein is an antibody that binds TRGV9, comprising a VH having an amino acid sequence having at least 95% identity to an amino acid sequence of SEQ ID NO:1799, and a VL having an amino acid sequence having at least 95% identity to an amino acid sequence of SEQ ID NO:1800. In one aspect, provided herein is an antibody that binds TRGV9, comprising a heavy chain having an amino acid sequence having at least 95% identity to an amino acid sequence of SEQ ID NO:1801. In one aspect, provided herein is an antibody that binds TRGV9, comprising a light chain having an amino acid sequence having at least 95% identity to an amino acid sequence of SEQ ID NO:1802. In one aspect, provided herein is an antibody that binds TRGV9, comprising a heavy chain having an amino acid sequence having at least 95% identity to an amino acid sequence of SEQ ID NO:1801, and a light chain having an amino acid sequence having at least 95% identity to an amino acid sequence of SEQ ID NO:1802.

In one aspect, provided herein is an antibody that binds TRGV9, comprising: (i) a VH comprising a VH CDR1, a VH CDR2, and a VH CDR3 having an amino acid sequence of SEQ ID NOs:1803, 1804, and 1805, respectively, and (ii) a VL comprising a VL CDR1, VL CDR2, and VL CDR3 having an amino acid sequence of SEQ ID NOs:1806, 1807, and 1808, respectively. In one aspect, provided herein is an antibody that binds TRGV9, comprising: (i) a VH comprising a VH CDR1, a VH CDR2, and a VH CDR3 having an amino acid sequence of SEQ ID NOs:1809, 1810, and 1811, respectively, and (ii) a VL comprising a VL CDR1, VL CDR2, and VL CDR3 having an amino acid sequence of SEQ ID NOs:1812, 1813, and 1814, respectively. In one aspect, provided herein is an antibody that binds TRGV9, comprising: (i) a VH comprising a VH CDR1, a VH CDR2, and a VH CDR3 having an amino acid sequence of SEQ ID NOs:1815, 1816, and 1817, respectively, and (ii) a VL comprising a VL CDR1, VL CDR2, and VL CDR3 having an amino acid sequence of SEQ ID NOs:1818, 1819, and 1820, respectively. In one aspect, provided herein is an antibody that binds TRGV9, comprising: (i) a VH comprising a VH CDR1, a VH CDR2, and a VH CDR3 having an amino acid sequence of SEQ ID NOs:1821, 1822, and 1823, respectively, and (ii) a VL comprising a VL CDR1, VL CDR2, and VL CDR3 having an amino acid sequence of SEQ ID NOs:1824, 1825, and 1826, respectively. In one aspect, provided herein is an antibody that binds TRGV9, comprising: (i) a VH comprising a VH CDR1, a VH CDR2, and a VH CDR3 having an amino acid sequence of SEQ ID NOs:1827, 1828, and 1829, respectively, and (ii) a VL comprising a VL CDR1, VL CDR2, and VL CDR3 having an amino acid sequence of SEQ ID NOs:1830, 1831, and 1832, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and (ii) a VL comprising a VL CDR1, a VL CDR2, and a VL CDR3 having an amino acid sequence of a VL CDR1, a VL CDR2, and a VL CDR3, respectively, of SEQ ID NO:1834. In one aspect, provided herein is an antibody that binds TRGV9, comprising a VH having an amino acid sequence of SEQ ID NO:1833. In one aspect, provided herein is an antibody that binds TRGV9, comprising a VL having an amino acid sequence of SEQ ID NO:1834. In one aspect, provided herein is an antibody that binds TRGV9, comprising a VH having an amino acid sequence of SEQ ID NO:1833, and a VL having an amino acid sequence of SEQ ID NO:1834. In one aspect, provided herein is an antibody that binds TRGV9, comprising a heavy chain having an amino acid sequence of SEQ ID NO:1835. In one aspect, provided herein is an antibody that binds TRGV9, comprising a light chain having an amino acid sequence of SEQ ID NO:1836. In one aspect, provided herein is an antibody that binds TRGV9, comprising a heavy chain having an amino acid sequence of SEQ ID NO:1835, and a light chain having an amino acid sequence of SEQ ID NO:1836. In one aspect, provided herein is an antibody that binds TRGV9, comprising a VH having an amino acid sequence having at least 95% identity to an amino acid sequence of SEQ ID NO:1833. In one aspect, provided herein is an antibody that binds TRGV9, comprising a VL having an amino acid sequence having at least 95% identity to an amino acid sequence of SEQ ID NO:1834. In one aspect, provided herein is an antibody that binds TRGV9, comprising a VH having an amino acid sequence having at least 95% identity to an amino acid sequence of SEQ ID NO:1833, and a VL having an amino acid sequence having at least 95% identity to an amino acid sequence of SEQ ID NO:1834. In one aspect, provided herein is an antibody that binds TRGV9, comprising a heavy chain having an amino acid sequence having at least 95% identity to an amino acid sequence of SEQ ID NO:1835. In one aspect, provided herein is an antibody that binds TRGV9, comprising a light chain having an amino acid sequence having at least 95% identity to an amino acid sequence of SEQ ID NO:1836. In one aspect, provided herein is an antibody that binds TRGV9, comprising a heavy chain having an amino acid sequence having at least 95% identity to an amino acid sequence of SEQ ID NO:1835, and a light chain having an amino acid sequence having at least 95% identity to an amino acid sequence of SEQ ID NO:1836.

In one aspect, provided herein is an antibody that binds TRGV9, comprising: (i) a VH comprising a VH CDR1, a VH CDR2, and a VH CDR3 having an amino acid sequence of SEQ ID NOs:1837, 1838, and 1839, respectively, and (ii) a VL comprising a VL CDR1, VL CDR2, and VL CDR3 having an amino acid sequence of SEQ ID NOs:1840, 1841, and 1842, respectively. In one aspect, provided herein is an antibody that binds TRGV9, comprising: (i) a VH comprising a VH CDR1, a VH CDR2, and a VH CDR3 having an amino acid sequence of SEQ ID NOs:1843, 1844, and 1845, respectively, and (ii) a VL comprising a VL CDR1, VL CDR2, and VL CDR3 having an amino acid sequence of SEQ ID NOs:1846, 1847, and 1848, respectively. In one aspect, provided herein is an antibody that binds TRGV9, comprising: (i) a VH comprising a VH CDR1, a VH CDR2, and a VH CDR3 having an amino acid sequence of SEQ ID NOs:1849, 1850, and 1851, respectively, and (ii) a VL comprising a VL CDR1, VL CDR2, and VL CDR3 having an amino acid sequence of SEQ ID NOs:1852, 1853, and 1854, respectively. In one aspect, provided herein is an antibody that binds TRGV9, comprising: (i) a VH comprising a VH CDR1, a VH CDR2, and a VH CDR3 having an amino acid sequence of SEQ ID NOs:1855, 1856, and 1857, respectively, and (ii) a VL comprising a VL CDR1, VL CDR2, and VL CDR3 having an amino acid sequence of SEQ ID NOs:1858, 1859, and 1860, respectively. In one aspect, provided herein is an antibody that binds TRGV9, comprising: (i) a VH comprising a VH CDR1, a VH CDR2, and a VH CDR3 having an amino acid sequence of SEQ ID NOs:1861, 1862, and 1863, respectively, and (ii) a VL comprising a VL CDR1, VL CDR2, and VL CDR3 having an amino acid sequence of SEQ ID NOs:1864, 1865, and 1866, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and (ii) a VL comprising a VL CDR1, a VL CDR2, and a VL CDR3 having an amino acid sequence of a VL CDR1, a VL CDR2, and a VL CDR3, respectively, of SEQ ID NO:1868. In one aspect, provided herein is an antibody that binds TRGV9, comprising a VH having an amino acid sequence of SEQ ID NO:1867. In one aspect, provided herein is an antibody that binds TRGV9, comprising a VL having an amino acid sequence of SEQ ID NO:1868. In one aspect, provided herein is an antibody that binds TRGV9, comprising a VH having an amino acid sequence of SEQ ID NO:1867, and a VL having an amino acid sequence of SEQ ID NO:1868. In one aspect, provided herein is an antibody that binds TRGV9, comprising a heavy chain having an amino acid sequence of SEQ ID NO:1869. In one aspect, provided herein is an antibody that binds TRGV9, comprising a light chain having an amino acid sequence of SEQ ID NO:1870. In one aspect, provided herein is an antibody that binds TRGV9, comprising a heavy chain having an amino acid sequence of SEQ ID NO:1869, and a light chain having an amino acid sequence of SEQ ID NO:1870. In one aspect, provided herein is an antibody that binds TRGV9, comprising a VH having an amino acid sequence having at least 95% identity to an amino acid sequence of SEQ ID NO:1867. In one aspect, provided herein is an antibody that binds TRGV9, comprising a VL having an amino acid sequence having at least 95% identity to an amino acid sequence of SEQ ID NO:1868. In one aspect, provided herein is an antibody that binds TRGV9, comprising a VH having an amino acid sequence having at least 95% identity to an amino acid sequence of SEQ ID NO:1867, and a VL having an amino acid sequence having at least 95% identity to an amino acid sequence of SEQ ID NO:1868. In one aspect, provided herein is an antibody that binds TRGV9, comprising a heavy chain having an amino acid sequence having at least 95% identity to an amino acid sequence of SEQ ID NO:1869. In one aspect, provided herein is an antibody that binds TRGV9, comprising a light chain having an amino acid sequence having at least 95% identity to an amino acid sequence of SEQ ID NO:1870. In one aspect, provided herein is an antibody that binds TRGV9, comprising a heavy chain having an amino acid sequence having at least 95% identity to an amino acid sequence of SEQ ID NO:1869, and a light chain having an amino acid sequence having at least 95% identity to an amino acid sequence of SEQ ID NO:1870.

In one aspect, provided herein is an antibody that binds TRGV9, comprising: (i) a VH comprising a VH CDR1, a VH CDR2, and a VH CDR3 having an amino acid sequence of SEQ ID NOs:1871, 1872, and 1873, respectively, and (ii) a VL comprising a VL CDR1, VL CDR2, and VL CDR3 having an amino acid sequence of SEQ ID NOs:1874, 1875, and 1876, respectively. In one aspect, provided herein is an antibody that binds TRGV9, comprising: (i) a VH comprising a VH CDR1, a VH CDR2, and a VH CDR3 having an amino acid sequence of SEQ ID NOs:1877, 1878, and 1879, respectively, and (ii) a VL comprising a VL CDR1, VL CDR2, and VL CDR3 having an amino acid sequence of SEQ ID NOs:1880, 1881, and 1882, respectively. In one aspect, provided herein is an antibody that binds TRGV9, comprising: (i) a VH comprising a VH CDR1, a VH CDR2, and a VH CDR3 having an amino acid sequence of SEQ ID NOs:1883, 1884, and 1885, respectively, and (ii) a VL comprising a VL CDR1, VL CDR2, and VL CDR3 having an amino acid sequence of SEQ ID NOs:1886, 1887, and 1888, respectively. In one aspect, provided herein is an antibody that binds TRGV9, comprising: (i) a VH comprising a VH CDR1, a VH CDR2, and a VH CDR3 having an amino acid sequence of SEQ ID NOs:1889, 1890, and 1891, respectively, and (ii) a VL comprising a VL CDR1, VL CDR2, and VL CDR3 having an amino acid sequence of SEQ ID NOs:1892, 1893, and 1894, respectively. In one aspect, provided herein is an antibody that binds TRGV9, comprising: (i) a VH comprising a VH CDR1, a VH CDR2, and a VH CDR3 having an amino acid sequence of SEQ ID NOs:1895, 1896, and 1897, respectively, and (ii) a VL comprising a VL CDR1, VL CDR2, and VL CDR3 having an amino acid sequence of SEQ ID NOs:1898, 1899, and 1900, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and (ii) a VL comprising a VL CDR1, a VL CDR2, and a VL CDR3 having an amino acid sequence of a VL CDR1, a VL CDR2, and a VL CDR3, respectively, of SEQ ID NO:1902. In one aspect, provided herein is an antibody that binds TRGV9, comprising a VH having an amino acid sequence of SEQ ID NO:1901. In one aspect, provided herein is an antibody that binds TRGV9, comprising a VL having an amino acid sequence of SEQ ID NO:1902. In one aspect, provided herein is an antibody that binds TRGV9, comprising a VH having an amino acid sequence of SEQ ID NO:1901, and a VL having an amino acid sequence of SEQ ID NO:1902. In one aspect, provided herein is an antibody that binds TRGV9, comprising a heavy chain having an amino acid sequence of SEQ ID NO:1903. In one aspect, provided herein is an antibody that binds TRGV9, comprising a light chain having an amino acid sequence of SEQ ID NO:1904. In one aspect, provided herein is an antibody that binds TRGV9, comprising a heavy chain having an amino acid sequence of SEQ ID NO:1903, and a light chain having an amino acid sequence of SEQ ID NO:1904. In one aspect, provided herein is an antibody that binds TRGV9, comprising a VH having an amino acid sequence having at least 95% identity to an amino acid sequence of SEQ ID NO:1901. In one aspect, provided herein is an antibody that binds TRGV9, comprising a VL having an amino acid sequence having at least 95% identity to an amino acid sequence of SEQ ID NO:1902. In one aspect, provided herein is an antibody that binds TRGV9, comprising a VH having an amino acid sequence having at least 95% identity to an amino acid sequence of SEQ ID NO:1901, and a VL having an amino acid sequence having at least 95% identity to an amino acid sequence of SEQ ID NO:1902. In one aspect, provided herein is an antibody that binds TRGV9, comprising a heavy chain having an amino acid sequence having at least 95% identity to an amino acid sequence of SEQ ID NO:1903. In one aspect, provided herein is an antibody that binds TRGV9, comprising a light chain having an amino acid sequence having at least 95% identity to an amino acid sequence of SEQ ID NO:1904. In one aspect, provided herein is an antibody that binds TRGV9, comprising a heavy chain having an amino acid sequence having at least 95% identity to an amino acid sequence of SEQ ID NO:1903, and a light chain having an amino acid sequence having at least 95% identity to an amino acid sequence of SEQ ID NO:1904.

In one aspect, provided herein is an antibody that binds TRGV9, comprising: (i) a VH comprising a VH CDR1, a VH CDR2, and a VH CDR3 having an amino acid sequence of SEQ ID NOs:1905, 1906, and 1907, respectively, and (ii) a VL comprising a VL CDR1, VL CDR2, and VL CDR3 having an amino acid sequence of SEQ ID NOs:1908, 1909, and 1910, respectively. In one aspect, provided herein is an antibody that binds TRGV9, comprising: (i) a VH comprising a VH CDR1, a VH CDR2, and a VH CDR3 having an amino acid sequence of SEQ ID NOs:1911, 1912, and 1913, respectively, and (ii) a VL comprising a VL CDR1, VL CDR2, and VL CDR3 having an amino acid sequence of SEQ ID NOs:1914, 1915, and 1916, respectively. In one aspect, provided herein is an antibody that binds TRGV9, comprising: (i) a VH comprising a VH CDR1, a VH CDR2, and a VH CDR3 having an amino acid sequence of SEQ ID NOs:1917, 1918, and 1919, respectively, and (ii) a VL comprising a VL CDR1, VL CDR2, and VL CDR3 having an amino acid sequence of SEQ ID NOs:1920, 1921, and 1922, respectively. In one aspect, provided herein is an antibody that binds TRGV9, comprising: (i) a VH comprising a VH CDR1, a VH CDR2, and a VH CDR3 having an amino acid sequence of SEQ ID NOs:1923, 1924, and 1925, respectively, and (ii) a VL comprising a VL CDR1, VL CDR2, and VL CDR3 having an amino acid sequence of SEQ ID NOs:1926, 1927, and 1928, respectively. In one aspect, provided herein is an antibody that binds TRGV9, comprising: (i) a VH comprising a VH CDR1, a VH CDR2, and a VH CDR3 having an amino acid sequence of SEQ ID NOs:1929, 1930, and 1931, respectively, and (ii) a VL comprising a VL CDR1, VL CDR2, and VL CDR3 having an amino acid sequence of SEQ ID NOs:1932, 1933, and 1934, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and (ii) a VL comprising a VL CDR1, a VL CDR2, and a VL CDR3 having an amino acid sequence of a VL CDR1, a VL CDR2, and a VL CDR3, respectively, of SEQ ID NO:1936. In one aspect, provided herein is an antibody that binds TRGV9, comprising a VH having an amino acid sequence of SEQ ID NO:1935. In one aspect, provided herein is an antibody that binds TRGV9, comprising a VL having an amino acid sequence of SEQ ID NO:1936. In one aspect, provided herein is an antibody that binds TRGV9, comprising a VH having an amino acid sequence of SEQ ID NO:1935, and a VL having an amino acid sequence of SEQ ID NO:1936. In one aspect, provided herein is an antibody that binds TRGV9, comprising a heavy chain having an amino acid sequence of SEQ ID NO:1937. In one aspect, provided herein is an antibody that binds TRGV9, comprising a light chain having an amino acid sequence of SEQ ID NO:1938. In one aspect, provided herein is an antibody that binds TRGV9, comprising a heavy chain having an amino acid sequence of SEQ ID NO:1937, and a light chain having an amino acid sequence of SEQ ID NO:1938. In one aspect, provided herein is an antibody that binds TRGV9, comprising a VH having an amino acid sequence having at least 95% identity to an amino acid sequence of SEQ ID NO:1935. In one aspect, provided herein is an antibody that binds TRGV9, comprising a VL having an amino acid sequence having at least 95% identity to an amino acid sequence of SEQ ID NO:1936. In one aspect, provided herein is an antibody that binds TRGV9, comprising a VH having an amino acid sequence having at least 95% identity to an amino acid sequence of SEQ ID NO:1935, and a VL having an amino acid sequence having at least 95% identity to an amino acid sequence of SEQ ID NO:1936. In one aspect, provided herein is an antibody that binds TRGV9, comprising a heavy chain having an amino acid sequence having at least 95% identity to an amino acid sequence of SEQ ID NO:1937. In one aspect, provided herein is an antibody that binds TRGV9, comprising a light chain having an amino acid sequence having at least 95% identity to an amino acid sequence of SEQ ID NO:1938. In one aspect, provided herein is an antibody that binds TRGV9, comprising a heavy chain having an amino acid sequence having at least 95% identity to an amino acid sequence of SEQ ID NO:1937, and a light chain having an amino acid sequence having at least 95% identity to an amino acid sequence of SEQ ID NO:1938.

In one aspect, provided herein is an antibody that binds TRGV9, comprising: (i) a VH comprising a VH CDR1, a VH CDR2, and a VH CDR3 having an amino acid sequence of SEQ ID NOs:1939, 1940, and 1941, respectively, and (ii) a VL comprising a VL CDR1, VL CDR2, and VL CDR3 having an amino acid sequence of SEQ ID NOs:1942, 1943, and 1944, respectively. In one aspect, provided herein is an antibody that binds TRGV9, comprising: (i) a VH comprising a VH CDR1, a VH CDR2, and a VH CDR3 having an amino acid sequence of SEQ ID NOs:1945, 1946, and 1947, respectively, and (ii) a VL comprising a VL CDR1, VL CDR2, and VL CDR3 having an amino acid sequence of SEQ ID NOs:1948, 1949, and 1950, respectively. In one aspect, provided herein is an antibody that binds TRGV9, comprising: (i) a VH comprising a VH CDR1, a VH CDR2, and a VH CDR3 having an amino acid sequence of SEQ ID NOs:1951, 1952, and 1953, respectively, and (ii) a VL comprising a VL CDR1, VL CDR2, and VL CDR3 having an amino acid sequence of SEQ ID NOs:1954, 1955, and 1956, respectively. In one aspect, provided herein is an antibody that binds TRGV9, comprising: (i) a VH comprising a VH CDR1, a VH CDR2, and a VH CDR3 having an amino acid sequence of SEQ ID NOs:1957, 1958, and 1959, respectively, and (ii) a VL comprising a VL CDR1, VL CDR2, and VL CDR3 having an amino acid sequence of SEQ ID NOs:1960, 1961, and 1962, respectively. In one aspect, provided herein is an antibody that binds TRGV9, comprising: (i) a VH comprising a VH CDR1, a VH CDR2, and a VH CDR3 having an amino acid sequence of SEQ ID NOs:1963, 1964, and 1965, respectively, and (ii) a VL comprising a VL CDR1, VL CDR2, and VL CDR3 having an amino acid sequence of SEQ ID NOs:1966, 1967, and 1968, respectively. In one aspect, provided herein is an antibody that binds TRGV9, comprising: (i) a VH comprising a VH CDR1, a VH CDR2, and a VH CDR3, respectively, of a VH CDR1, a VH CDR2, and a VH CDR3, respectively, of SEQ ID NO:1969; and (ii) a VL comprising a VL CDR1, a VL CDR2, and a VL CDR3 having an amino acid sequence of a VL CDR1, a VL CDR2, and a VL CDR3, respectively, of SEQ ID NO:1970. In one aspect, provided herein is an antibody that binds TRGV9, comprising a VH having an amino acid sequence of SEQ ID NO:1969. In one aspect, provided herein is an antibody that binds TRGV9, comprising a VL having an amino acid sequence of SEQ ID NO:1970. In one aspect, provided herein is an antibody that binds TRGV9, comprising a VH having an amino acid sequence of SEQ ID NO:1969, and a VL having an amino acid sequence of SEQ ID NO:1970. In one aspect, provided herein is an antibody that binds TRGV9, comprising a heavy chain having an amino acid sequence of SEQ ID NO:1971. In one aspect, provided herein is an antibody that binds TRGV9, comprising a light chain having an amino acid sequence of SEQ ID NO:1972. In one aspect, provided herein is an antibody that binds TRGV9, comprising a heavy chain having an amino acid sequence of SEQ ID NO:1971, and a light chain having an amino acid sequence of SEQ ID NO:1972. In one aspect, provided herein is an antibody that binds TRGV9, comprising a VH having an amino acid sequence having at least 95% identity to an amino acid sequence of SEQ ID NO:1969. In one aspect, provided herein is an antibody that binds TRGV9, comprising a VL having an amino acid sequence having at least 95% identity to an amino acid sequence of SEQ ID NO:1970. In one aspect, provided herein is an antibody that binds TRGV9, comprising a VH having an amino acid sequence having at least 95% identity to an amino acid sequence of SEQ ID NO:1969, and a VL having an amino acid sequence having at least 95% identity to an amino acid sequence of SEQ ID NO:1970. In one aspect, provided herein is an antibody that binds TRGV9, comprising a heavy chain having an amino acid sequence having at least 95% identity to an amino acid sequence of SEQ ID NO:1971. In one aspect, provided herein is an antibody that binds TRGV9, comprising a light chain having an amino acid sequence having at least 95% identity to an amino acid sequence of SEQ ID NO:1972. In one aspect, provided herein is an antibody that binds TRGV9, comprising a heavy chain having an amino acid sequence having at least 95% identity to an amino acid sequence of SEQ ID NO:1971, and a light chain having an amino acid sequence having at least 95% identity to an amino acid sequence of SEQ ID NO:1972.

In one aspect, provided herein is an antibody that binds TRGV9, comprising: (i) a VH comprising a VH CDR1, a VH CDR2, and a VH CDR3 having an amino acid sequence of SEQ ID NOs:1973, 1974, and 1975, respectively, and (ii) a VL comprising a VL CDR1, VL CDR2, and VL CDR3 having an amino acid sequence of SEQ ID NOs:1976, 1977, and 1978, respectively. In one aspect, provided herein is an antibody that binds TRGV9, comprising: (i) a VH comprising a VH CDR1, a VH CDR2, and a VH CDR3 having an amino acid sequence of SEQ ID NOs:1979, 1980, and 1981, respectively, and (ii) a VL comprising a VL CDR1, VL CDR2, and VL CDR3 having an amino acid sequence of SEQ ID NOs:1982, 1983, and 1984, respectively. In one aspect, provided herein is an antibody that binds TRGV9, comprising: (i) a VH comprising a VH CDR1, a VH CDR2, and a VH CDR3 having an amino acid sequence of SEQ ID NOs:1985, 1986, and 1987, respectively, and (ii) a VL comprising a VL CDR1, VL CDR2, and VL CDR3 having an amino acid sequence of SEQ ID NOs:1988, 1989, and 1990, respectively. In one aspect, provided herein is an antibody that binds TRGV9, comprising: (i) a VH comprising a VH CDR1, a VH CDR2, and a VH CDR3 having an amino acid sequence of SEQ ID NOs:1991, 1992, and 1993, respectively, and (ii) a VL comprising a VL CDR1, VL CDR2, and VL CDR3 having an amino acid sequence of SEQ ID NOs:1994, 1995, and 1996, respectively. In one aspect, provided herein is an antibody that binds TRGV9, comprising: (i) a VH comprising a VH CDR1, a VH CDR2, and a VH CDR3 having an amino acid sequence of SEQ ID NOs:1997, 1998, and 1999, respectively, and (ii) a VL comprising a VL CDR1, VL CDR2, and VL CDR3 having an amino acid sequence of SEQ ID NOs:2000, 2001, and 2002, respectively. In one aspect, provided herein is an antibody that binds TRGV9, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and (ii) a VL comprising a VL CDR1, a VL CDR2, and a VL CDR3 having an amino acid sequence of a VL CDR1, a VL CDR2, and a VL CDR3, respectively, of SEQ ID NO:2004. In one aspect, provided herein is an antibody that binds TRGV9, comprising a VH having an amino acid sequence of SEQ ID NO:2003. In one aspect, provided herein is an antibody that binds TRGV9, comprising a VL having an amino acid sequence of SEQ ID NO:2004. In one aspect, provided herein is an antibody that binds TRGV9, comprising a VH having an amino acid sequence of SEQ ID NO:2003, and a VL having an amino acid sequence of SEQ ID NO:2004. In one aspect, provided herein is an antibody that binds TRGV9, comprising a heavy chain having an amino acid sequence of SEQ ID NO:2005. In one aspect, provided herein is an antibody that binds TRGV9, comprising a light chain having an amino acid sequence of SEQ ID NO:2006. In one aspect, provided herein is an antibody that binds TRGV9, comprising a heavy chain having an amino acid sequence of SEQ ID NO:2005, and a light chain having an amino acid sequence of SEQ ID NO:2006. In one aspect, provided herein is an antibody that binds TRGV9, comprising a VH having an amino acid sequence having at least 95% identity to an amino acid sequence of SEQ ID NO:2003. In one aspect, provided herein is an antibody that binds TRGV9, comprising a VL having an amino acid sequence having at least 95% identity to an amino acid sequence of SEQ ID NO:2004. In one aspect, provided herein is an antibody that binds TRGV9, comprising a VH having an amino acid sequence having at least 95% identity to an amino acid sequence of SEQ ID NO:2003, and a VL having an amino acid sequence having at least 95% identity to an amino acid sequence of SEQ ID NO:2004. In one aspect, provided herein is an antibody that binds TRGV9, comprising a heavy chain having an amino acid sequence having at least 95% identity to an amino acid sequence of SEQ ID NO:2005. In one aspect, provided herein is an antibody that binds TRGV9, comprising a light chain having an amino acid sequence having at least 95% identity to an amino acid sequence of SEQ ID NO:2006. In one aspect, provided herein is an antibody that binds TRGV9, comprising a heavy chain having an amino acid sequence having at least 95% identity to an amino acid sequence of SEQ ID NO:2005, and a light chain having an amino acid sequence having at least 95% identity to an amino acid sequence of SEQ ID NO:2006.

In one aspect, provided herein is an antibody that binds TRGV9. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003. In one embodiment, the TRGV9 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004. In one embodiment, the TRGV9 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004. In some embodiments, the TRGV9 antibody is a multispecific antibody. In some embodiments, the TRGV9 antibody is a bispecific antibody. In some embodiments, the TRGV9 antibody is a trispecific antibody. In some embodiments, the TRGV9 antibody is a quadraspecific antibody.

In one aspect, provided herein is an antibody that binds TRGV9, comprising a VH CDR1 having an amino acid sequence of SEQ ID NO:25, wherein the third amino acid is A or T; a VH CDR2 having an amino acid sequence of SEQ ID NO:26, wherein the second amino acid is G or S, the fourth amino acid is S or T, the sixth amino acid is D or S; and a VH CDR3 having an amino acid sequence of SEQ ID NO:27, wherein the first amino acid is A, G, or V, the second amino acid is K, R, or T, the fourth amino acid is D, H, or G, the fifth amino acid is D, E, or V, the sixth amino acid is F, L, or Y, the eighth amino acid is A, G, P, or V, the ninth amino acid is F or L, the third amino acid is I of V. In one aspect, provided herein is an antibody that binds TRGV9, comprising a VL CDR1 having an amino acid sequence of SEQ ID NO:28, wherein the third amino acid is I or V, the fourth amino acid is R or S; a VL CDR2 having an amino acid sequence of SEQ ID NO:29, wherein the first amino acid is A, P or S; and a VL CDR3 having an amino acid sequence of SEQ ID NO:30, wherein the third amino acid is F or Y. In one aspect, provided herein is an antibody that binds TRGV9, comprising a VH CDR1 having an amino acid sequence of SEQ ID NO:25, wherein the third amino acid is A or T; a VH CDR2 having an amino acid sequence of SEQ ID NO:26, wherein the second amino acid is G or S, the fourth amino acid is S or T, the sixth amino acid is D or S; and a VH CDR3 having an amino acid sequence of SEQ ID NO:27, wherein the first amino acid is A, G, or V, the second amino acid is K, R, or T, the fourth amino acid is D, H, or G, the fifth amino acid is D, E, or V, the sixth amino acid is F, L, or Y, the eighth amino acid is A, G, P, or V, the ninth amino acid is F or L, the third amino acid is I of V; a VL CDR1 having an amino acid sequence of SEQ ID NO:28, wherein the third amino acid is I or V, the fourth amino acid is R or S; a VL CDR2 having an amino acid sequence of SEQ ID NO:29, wherein the first amino acid is A, P or S; and a VL CDR3 having an amino acid sequence of SEQ ID NO:30, wherein the third amino acid is F or Y.

In one aspect, provided herein is an antibody that binds TRGV9, comprising a VH CDR1 having an amino acid sequence of SEQ ID NO:93; a VH CDR2 having an amino acid sequence of SEQ ID NO:94; a VH CDR3 having an amino acid sequence of SEQ ID NO:95. In one aspect, provided herein is an antibody that binds TRGV9, comprising a VL CDR1 having an amino acid sequence of SEQ ID NO:96; a VL CDR2 having an amino acid sequence of SEQ ID NO:97; and a VL CDR3 having an amino acid sequence of SEQ ID NO:98, wherein the third amino acid is A or Y, the fourth is N or S, the sixth is F or W, and the eighth is R or W. In one aspect, provided herein is an antibody that binds TRGV9, comprising a VH CDR1 having an amino acid sequence of SEQ ID NO:93; a VH CDR2 having an amino acid sequence of SEQ ID NO:94; a VH CDR3 having an amino acid sequence of SEQ ID NO:95; a VL CDR1 having an amino acid sequence of SEQ ID NO:96; a VL CDR2 having an amino acid sequence of SEQ ID NO:97; and a VL CDR3 having an amino acid sequence of SEQ ID NO:98, wherein the third amino acid is A or Y, the fourth is N or S, the sixth is F or W, and the eighth is R or W.

In one aspect, provided herein is an antibody that binds TRGV9, comprising a VH CDR1 having an amino acid sequence of SEQ ID NO:127, wherein the first amino acid if G or R, the fourth amino acid is F or L, the fifth amino acid if R or S; a VH CDR2 having an amino acid sequence of SEQ ID NO:128, wherein the second amino acid is S or T, the third amino acid is S or T, the fourth amino acid is S or T, the sixth amino acid is G, S, or Y; a VH CDR3 having an amino acid sequence of SEQ ID NO:129, wherein the fourth amino acid is L or R, the sixth amino acid if I or V, the seventh amino acid A, G, or R, the eighth amino acid is G or B, the ninth amino acid is A, T, or V, the tenth amino acid is D or G, the eleventh amino acid is D or Y, the sixteenth amino acid is L or M. In one aspect, provided herein is an antibody that binds TRGV9, comprising a VL CDR1 having an amino acid sequence of SEQ ID NO:130; a VL CDR2 having an amino acid sequence of SEQ ID NO:131; and a VL CDR3 having an amino acid sequence of SEQ ID NO:132. In one aspect, provided herein is an antibody that binds TRGV9, comprising a VH CDR1 having an amino acid sequence of SEQ ID NO:127, wherein the first amino acid if G or R, the fourth amino acid is F or L, the fifth amino acid if R or S; a VH CDR2 having an amino acid sequence of SEQ ID NO:128, wherein the second amino acid is S or T, the third amino acid is S or T, the fourth amino acid is S or T, the sixth amino acid is G, S, or Y; a VH CDR3 having an amino acid sequence of SEQ ID NO:129, wherein the fourth amino acid is L or R, the sixth amino acid if I or V, the seventh amino acid A, G, or R, the eighth amino acid is G or B, the ninth amino acid is A, T, or V, the tenth amino acid is D or G, the eleventh amino acid is D or Y, the sixteenth amino acid is L or M; a VL CDR1 having an amino acid sequence of SEQ ID NO:130; a VL CDR2 having an amino acid sequence of SEQ ID NO:131; and a VL CDR3 having an amino acid sequence of SEQ ID NO:132.

In one aspect, provided herein is an antibody that binds TRGV9, comprising a VH CDR1 having an amino acid sequence of SEQ ID NO:297, wherein the fifth amino acid is N or S, the sixth amino acid is N or S; a VH CDR2 having an amino acid sequence of SEQ ID NO:298; a VH CDR3 having an amino acid sequence of SEQ ID NO:299, wherein the fourth amino acid is R or V, the sixth amino acid is I or V, the seventh amino acid is G or T, the eighth amino acid is G or T, the twelfth amino acid is S or Y, the fourteenth amino acid is A or G. In one aspect, provided herein is an antibody that binds TRGV9, comprising a VL CDR1 having an amino acid sequence of SEQ ID NO:300, wherein the fourth amino acid is A or S; a VL CDR2 having an amino acid sequence of SEQ ID NO:301 and a VL CDR3 having an amino acid sequence of SEQ ID NO:302. In one aspect, provided herein is an antibody that binds TRGV9, comprising a VH CDR1 having an amino acid sequence of SEQ ID NO:297, wherein the fifth amino acid is N or S, the sixth amino acid is N or S; a VH CDR2 having an amino acid sequence of SEQ ID NO:298; a VH CDR3 having an amino acid sequence of SEQ ID NO:299, wherein the fourth amino acid is R or V, the sixth amino acid is I or V, the seventh amino acid is G or T, the eighth amino acid is G or T, the twelfth amino acid is S or Y, the fourteenth amino acid is A or G; a VL CDR1 having an amino acid sequence of SEQ ID NO:300, wherein the fourth amino acid is A or S; a VL CDR2 having an amino acid sequence of SEQ ID NO:301 and a VL CDR3 having an amino acid sequence of SEQ ID NO:302.

In one aspect, provided herein is an antibody that binds TRGV9, comprising a VH CDR1 having an amino acid sequence of SEQ ID NO:569; a VH CDR2 having an amino acid sequence of SEQ ID NO:570; a VH CDR3 having an amino acid sequence of SEQ ID NO:571. In one aspect, provided herein is an antibody that binds TRGV9, comprising a VL CDR1 having an amino acid sequence of SEQ ID NO:572, wherein the second amino acid is G or N, the third amino acid is I or V, the fourth amino acid is A or S, the fifth amino acid is S or there is no amino acid added to the fifth position and sequence continues to the sixth position; a VL CDR2 having an amino acid sequence of SEQ ID NO:573, wherein the first amino acid is A or G, the third amino acid is C or S; and a VL CDR3 having an amino acid sequence of SEQ ID NO:574, wherein the second amino acid is K or Q, the fourth amino acid is G or N, the sixth amino acid is A or S, the ninth amino acid is Y or W. In one aspect, provided herein is an antibody that binds TRGV9, comprising a VH CDR1 having an amino acid sequence of SEQ ID NO:569; a VH CDR2 having an amino acid sequence of SEQ ID NO:570; a VH CDR3 having an amino acid sequence of SEQ ID NO:571; a VL CDR1 having an amino acid sequence of SEQ ID NO:572, wherein the second amino acid is G or N, the third amino acid is I or V, the fourth amino acid is A or S, the fifth amino acid is S or there is no amino acid added to the fifth position and sequence continues to the sixth position; a VL CDR2 having an amino acid sequence of SEQ ID NO:573, wherein the first amino acid is A or G, the third amino acid is C or S; and a VL CDR3 having an amino acid sequence of SEQ ID NO:574, wherein the second amino acid is K or Q, the fourth amino acid is G or N, the sixth amino acid is A or S, the ninth amino acid is Y or W.

In one aspect, provided herein is an antibody that binds TRGV9, comprising a VH CDR1 having an amino acid sequence of SEQ ID NO:739; a VH CDR2 having an amino acid sequence of SEQ ID NO:740; a VH CDR3 having an amino acid sequence of SEQ ID NO:741, wherein the third amino acid is D or E, the fourth amino acid is I or L, the sixth amino acid I or V, the eleventh amino acid is M or Y, the twelfth amino acid is D or Y, the thirteenth amino acid is Q or Y, the fourteenth amino acid is D or Y. In one aspect, provided herein is an antibody that binds TRGV9, comprising a VL CDR1 having an amino acid sequence of SEQ ID NO:742, wherein the third amino acid is F or V, the sixth amino acid is N or S; a VL CDR2 having an amino acid sequence of SEQ ID NO:743; and a VL CDR3 having an amino acid sequence of SEQ ID NO:744. In one aspect, provided herein is an antibody that binds TRGV9, comprising a VH CDR1 having an amino acid sequence of SEQ ID NO:739; a VH CDR2 having an amino acid sequence of SEQ ID NO:740; a VH CDR3 having an amino acid sequence of SEQ ID NO:741, wherein the third amino acid is D or E, the fourth amino acid is I or L, the sixth amino acid I or V, the eleventh amino acid is M or Y, the twelfth amino acid is D or Y, the thirteenth amino acid is Q or Y, the fourteenth amino acid is D or Y; a VL CDR1 having an amino acid sequence of SEQ ID NO:742, wherein the third amino acid is F or V, the sixth amino acid is N or S; a VL CDR2 having an amino acid sequence of SEQ ID NO:743; and a VL CDR3 having an amino acid sequence of SEQ ID NO:744.

In one aspect, provided herein is an antibody that binds TRGV9, comprising a VH CDR1 having an amino acid sequence of SEQ ID NO:1181, wherein the fifth amino acid is G or S, the sixth amino acid is A or S; a VH CDR2 having an amino acid sequence of SEQ ID NO:1182, wherein the third amino acid is S or T; a VH CDR3 having an amino acid sequence of SEQ ID NO:1183, wherein the sixth amino acid is I or M, the seventh amino acid is L or V, the eighth amino acid is A or S, the ninth amino acid is P or T, the eleventh amino acid is K or R. In one aspect, provided herein is an antibody that binds TRGV9, comprising a VL CDR1 having an amino acid sequence of SEQ ID NO:1184, wherein the fifth amino acid is D or N, the eighth amino acid is A or D; a VL CDR2 having an amino acid sequence of SEQ ID NO:1185; and a VL CDR3 having an amino acid sequence of SEQ ID NO:1186. In one aspect, provided herein is an antibody that binds TRGV9, comprising a VH CDR1 having an amino acid sequence of SEQ ID NO:1181, wherein the fifth amino acid is G or S, the sixth amino acid is A or S; a VH CDR2 having an amino acid sequence of SEQ ID NO:1182, wherein the third amino acid is S or T; a VH CDR3 having an amino acid sequence of SEQ ID NO:1183, wherein the sixth amino acid is I or M, the seventh amino acid is L or V, the eighth amino acid is A or S, the ninth amino acid is P or T, the eleventh amino acid is K or R; a VL CDR1 having an amino acid sequence of SEQ ID NO:1184, wherein the fifth amino acid is D or N, the eighth amino acid is A or D; a VL CDR2 having an amino acid sequence of SEQ ID NO:1185; and a VL CDR3 having an amino acid sequence of SEQ ID NO:1186.

In one aspect, provided herein is an antibody that binds to TRDV2. In some embodiments, the antibody comprises a heavy chain variable region and a light chain variable region. In some embodiments, the TRDV2 antibody is a humanized antibody.

In one aspect, provided herein is an antibody that binds TRDV2, comprising: (i) a VH comprising a VH CDR1, a VH CDR2, and a VH CDR3 having an amino acid sequence of SEQ ID NOs:2007, 2008, and 2009, respectively, and (ii) a VL comprising a VL CDR1, VL CDR2, and VL CDR3 having an amino acid sequence of SEQ ID NOs:2010, 2011, and 2012, respectively. In one aspect, provided herein is an antibody that binds TRDV2, comprising: (i) a VH comprising a VH CDR1, a VH CDR2, and a VH CDR3 having an amino acid sequence of SEQ ID NOs:2013, 2014, and 2015, respectively, and (ii) a VL comprising a VL CDR1, VL CDR2, and VL CDR3 having an amino acid sequence of SEQ ID NOs:2016, 2017, and 2018, respectively. In one aspect, provided herein is an antibody that binds TRDV2, comprising: (i) a VH comprising a VH CDR1, a VH CDR2, and a VH CDR3 having an amino acid sequence of SEQ ID NOs:2019, 2020, and 2021, respectively, and (ii) a VL comprising a VL CDR1, VL CDR2, and VL CDR3 having an amino acid sequence of SEQ ID NOs:2022, 2023, and 2024, respectively. In one aspect, provided herein is an antibody that binds TRDV2, comprising: (i) a VH comprising a VH CDR1, a VH CDR2, and a VH CDR3 having an amino acid sequence of SEQ ID NOs:2025, 2026, and 2027, respectively, and (ii) a VL comprising a VL CDR1, VL CDR2, and VL CDR3 having an amino acid sequence of SEQ ID NOs:2028, 2029, and 2030, respectively. In one aspect, provided herein is an antibody that binds TRDV2, comprising: (i) a VH comprising a VH CDR1, a VH CDR2, and a VH CDR3 having an amino acid sequence of SEQ ID NOs:2031, 2032, and 2033, respectively, and (ii) a VL comprising a VL CDR1, VL CDR2, and VL CDR3 having an amino acid sequence of SEQ ID NOs:2034, 2035, and 2036, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of SEQ ID NO:2038. In one aspect, provided herein is an antibody that binds TRDV2, comprising a VH having an amino acid sequence of SEQ ID NO:2037. In one aspect, provided herein is an antibody that binds TRDV2, comprising a VL having an amino acid sequence of SEQ ID NO:2038. In one aspect, provided herein is an antibody that binds TRDV2, comprising a VH having an amino acid sequence of SEQ ID NO:2037, and a VL having an amino acid sequence of SEQ ID NO:2038. In one aspect, provided herein is an antibody that binds TRDV2, comprising a heavy chain having an amino acid sequence of SEQ ID NO:2039. In one aspect, provided herein is an antibody that binds TRDV2, comprising a light chain having an amino acid sequence of SEQ ID NO:2040. In one aspect, provided herein is an antibody that binds TRDV2, comprising a heavy chain having an amino acid sequence of SEQ ID NO:2039, and a light chain having an amino acid sequence of SEQ ID NO:2040. In one aspect, provided herein is an antibody that binds TRDV2, comprising a VH having an amino acid sequence having at least 95% identity to an amino acid sequence of SEQ ID NO:2037. In one aspect, provided herein is an antibody that binds TRDV2, comprising a VL having an amino acid sequence having at least 95% identity to an amino acid sequence of SEQ ID NO:2038. In one aspect, provided herein is an antibody that binds TRDV2, comprising a VH having an amino acid sequence having at least 95% identity to an amino acid sequence of SEQ ID NO:2037, and a VL having an amino acid sequence having at least 95% identity to an amino acid sequence of SEQ ID NO:2038. In one aspect, provided herein is an antibody that binds TRDV2, comprising a heavy chain having an amino acid sequence having at least 95% identity to an amino acid sequence of SEQ ID NO:2039. In one aspect, provided herein is an antibody that binds TRDV2, comprising a light chain having an amino acid sequence having at least 95% identity to an amino acid sequence of SEQ ID NO:2040. In one aspect, provided herein is an antibody that binds TRDV2, comprising a heavy chain having an amino acid sequence having at least 95% identity to an amino acid sequence of SEQ ID NO:2039, and a light chain having an amino acid sequence having at least 95% identity to an amino acid sequence of SEQ ID NO:2040.

In one aspect, provided herein is an antibody that binds TRDV2, comprising: (i) a VH comprising a VH CDR1, a VH CDR2, and a VH CDR3 having an amino acid sequence of SEQ ID NOs:2041, 2042, and 2043, respectively, and (ii) a VL comprising a VL CDR1, VL CDR2, and VL CDR3 having an amino acid sequence of SEQ ID NOs:2044, 2045, and 2046, respectively. In one aspect, provided herein is an antibody that binds TRDV2, comprising: (i) a VH comprising a VH CDR1, a VH CDR2, and a VH CDR3 having an amino acid sequence of SEQ ID NOs:2047, 2048, and 2049, respectively, and (ii) a VL comprising a VL CDR1, VL CDR2, and VL CDR3 having an amino acid sequence of SEQ ID NOs:2050, 2051, and 2052, respectively. In one aspect, provided herein is an antibody that binds TRDV2, comprising: (i) a VH comprising a VH CDR1, a VH CDR2, and a VH CDR3 having an amino acid sequence of SEQ ID NOs:2053, 2054, and 2055, respectively, and (ii) a VL comprising a VL CDR1, VL CDR2, and VL CDR3 having an amino acid sequence of SEQ ID NOs:2056, 2057, and 2058, respectively. In one aspect, provided herein is an antibody that binds TRDV2, comprising: (i) a VH comprising a VH CDR1, a VH CDR2, and a VH CDR3 having an amino acid sequence of SEQ ID NOs:2059, 2060, and 2061, respectively, and (ii) a VL comprising a VL CDR1, VL CDR2, and VL CDR3 having an amino acid sequence of SEQ ID NOs:2062, 2063, and 2064, respectively. In one aspect, provided herein is an antibody that binds TRDV2, comprising: (i) a VH comprising a VH CDR1, a VH CDR2, and a VH CDR3 having an amino acid sequence of SEQ ID NOs:2065, 2066, and 2067, respectively, and (ii) a VL comprising a VL CDR1, VL CDR2, and VL CDR3 having an amino acid sequence of SEQ ID NOs:2068, 2069, and 2070, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of SEQ ID NO:2072. In one aspect, provided herein is an antibody that binds TRDV2, comprising a VH having an amino acid sequence of SEQ ID NO:2071. In one aspect, provided herein is an antibody that binds TRDV2, comprising a VL having an amino acid sequence of SEQ ID NO:2072. In one aspect, provided herein is an antibody that binds TRDV2, comprising a VH having an amino acid sequence of SEQ ID NO:2071, and a VL having an amino acid sequence of SEQ ID NO:2072. In one aspect, provided herein is an antibody that binds TRDV2, comprising a heavy chain having an amino acid sequence of SEQ ID NO:2073. In one aspect, provided herein is an antibody that binds TRDV2, comprising a light chain having an amino acid sequence of SEQ ID NO:2074. In one aspect, provided herein is an antibody that binds TRDV2, comprising a heavy chain having an amino acid sequence of SEQ ID NO:2073, and a light chain having an amino acid sequence of SEQ ID NO:2074. In one aspect, provided herein is an antibody that binds TRDV2, comprising a VH having an amino acid sequence having at least 95% identity to an amino acid sequence of SEQ ID NO:2071. In one aspect, provided herein is an antibody that binds TRDV2, comprising a VL having an amino acid sequence having at least 95% identity to an amino acid sequence of SEQ ID NO:2072. In one aspect, provided herein is an antibody that binds TRDV2, comprising a VH having an amino acid sequence having at least 95% identity to an amino acid sequence of SEQ ID NO:2071, and a VL having an amino acid sequence having at least 95% identity to an amino acid sequence of SEQ ID NO:2072. In one aspect, provided herein is an antibody that binds TRDV2, comprising a heavy chain having an amino acid sequence having at least 95% identity to an amino acid sequence of SEQ ID NO:2073. In one aspect, provided herein is an antibody that binds TRDV2, comprising a light chain having an amino acid sequence having at least 95% identity to an amino acid sequence of SEQ ID NO:2074. In one aspect, provided herein is an antibody that binds TRDV2, comprising a heavy chain having an amino acid sequence having at least 95% identity to an amino acid sequence of SEQ ID NO:2073, and a light chain having an amino acid sequence having at least 95% identity to an amino acid sequence of SEQ ID NO:2074.

In one aspect, provided herein is an antibody that binds TRDV2, comprising: (i) a VH comprising a VH CDR1, a VH CDR2, and a VH CDR3 having an amino acid sequence of SEQ ID NOs:2075, 2076, and 2077, respectively, and (ii) a VL comprising a VL CDR1, VL CDR2, and VL CDR3 having an amino acid sequence of SEQ ID NOs:2078, 2079, and 2080, respectively. In one aspect, provided herein is an antibody that binds TRDV2, comprising: (i) a VH comprising a VH CDR1, a VH CDR2, and a VH CDR3 having an amino acid sequence of SEQ ID NOs:2081, 2082, and 2083, respectively, and (ii) a VL comprising a VL CDR1, VL CDR2, and VL CDR3 having an amino acid sequence of SEQ ID NOs:2084, 2085, and 2086, respectively. In one aspect, provided herein is an antibody that binds TRDV2, comprising: (i) a VH comprising a VH CDR1, a VH CDR2, and a VH CDR3 having an amino acid sequence of SEQ ID NOs:2087, 2088, and 2089, respectively, and (ii) a VL comprising a VL CDR1, VL CDR2, and VL CDR3 having an amino acid sequence of SEQ ID NOs:2090, 2091, and 2092, respectively. In one aspect, provided herein is an antibody that binds TRDV2, comprising: (i) a VH comprising a VH CDR1, a VH CDR2, and a VH CDR3 having an amino acid sequence of SEQ ID NOs:2093, 2094, and 2095, respectively, and (ii) a VL comprising a VL CDR1, VL CDR2, and VL CDR3 having an amino acid sequence of SEQ ID NOs:2096, 2097, and 2098, respectively. In one aspect, provided herein is an antibody that binds TRDV2, comprising: (i) a VH comprising a VH CDR1, a VH CDR2, and a VH CDR3 having an amino acid sequence of SEQ ID NOs:2099, 2100, and 2101, respectively, and (ii) a VL comprising a VL CDR1, VL CDR2, and VL CDR3 having an amino acid sequence of SEQ ID NOs:2102, 2103, and 2104, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of SEQ ID NO:2106. In one aspect, provided herein is an antibody that binds TRDV2, comprising a VH having an amino acid sequence of SEQ ID NO:2105. In one aspect, provided herein is an antibody that binds TRDV2, comprising a VL having an amino acid sequence of SEQ ID NO:2106. In one aspect, provided herein is an antibody that binds TRDV2, comprising a VH having an amino acid sequence of SEQ ID NO:2105, and a VL having an amino acid sequence of SEQ ID NO:2106. In one aspect, provided herein is an antibody that binds TRDV2, comprising a heavy chain having an amino acid sequence of SEQ ID NO:2107. In one aspect, provided herein is an antibody that binds TRDV2, comprising a light chain having an amino acid sequence of SEQ ID NO:2108. In one aspect, provided herein is an antibody that binds TRDV2, comprising a heavy chain having an amino acid sequence of SEQ ID NO:2107, and a light chain having an amino acid sequence of SEQ ID NO:2108. In one aspect, provided herein is an antibody that binds TRDV2, comprising a VH having an amino acid sequence having at least 95% identity to an amino acid sequence of SEQ ID NO:2105. In one aspect, provided herein is an antibody that binds TRDV2, comprising a VL having an amino acid sequence having at least 95% identity to an amino acid sequence of SEQ ID NO:2106. In one aspect, provided herein is an antibody that binds TRDV2, comprising a VH having an amino acid sequence having at least 95% identity to an amino acid sequence of SEQ ID NO:2105, and a VL having an amino acid sequence having at least 95% identity to an amino acid sequence of SEQ ID NO:2106. In one aspect, provided herein is an antibody that binds TRDV2, comprising a heavy chain having an amino acid sequence having at least 95% identity to an amino acid sequence of SEQ ID NO:2107. In one aspect, provided herein is an antibody that binds TRDV2, comprising a light chain having an amino acid sequence having at least 95% identity to an amino acid sequence of SEQ ID NO:2108. In one aspect, provided herein is an antibody that binds TRDV2, comprising a heavy chain having an amino acid sequence having at least 95% identity to an amino acid sequence of SEQ ID NO:2107, and a light chain having an amino acid sequence having at least 95% identity to an amino acid sequence of SEQ ID NO:2108.

In one aspect, provided herein is an antibody that binds TRDV2, comprising: (i) a VH comprising a VH CDR1, a VH CDR2, and a VH CDR3 having an amino acid sequence of SEQ ID NOs:2109, 2110, and 2111, respectively, and (ii) a VL comprising a VL CDR1, VL CDR2, and VL CDR3 having an amino acid sequence of SEQ ID NOs:2112, 2113, and 2114, respectively. In one aspect, provided herein is an antibody that binds TRDV2, comprising: (i) a VH comprising a VH CDR1, a VH CDR2, and a VH CDR3 having an amino acid sequence of SEQ ID NOs:2115, 2116, and 2117, respectively, and (ii) a VL comprising a VL CDR1, VL CDR2, and VL CDR3 having an amino acid sequence of SEQ ID NOs:2118, 2119, and 2120, respectively. In one aspect, provided herein is an antibody that binds TRDV2, comprising: (i) a VH comprising a VH CDR1, a VH CDR2, and a VH CDR3 having an amino acid sequence of SEQ ID NOs:2121, 2122, and 2123, respectively, and (ii) a VL comprising a VL CDR1, VL CDR2, and VL CDR3 having an amino acid sequence of SEQ ID NOs:2124, 2125, and 2126, respectively. In one aspect, provided herein is an antibody that binds TRDV2, comprising: (i) a VH comprising a VH CDR1, a VH CDR2, and a VH CDR3 having an amino acid sequence of SEQ ID NOs:2127, 2128, and 2129, respectively, and (ii) a VL comprising a VL CDR1, VL CDR2, and VL CDR3 having an amino acid sequence of SEQ ID NOs:2130, 2131, and 2132, respectively. In one aspect, provided herein is an antibody that binds TRDV2, comprising: (i) a VH comprising a VH CDR1, a VH CDR2, and a VH CDR3 having an amino acid sequence of SEQ ID NOs:2133, 2134, and 2135, respectively, and (ii) a VL comprising a VL CDR1, VL CDR2, and VL CDR3 having an amino acid sequence of SEQ ID NOs:2136, 2137, and 2138, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of SEQ ID NO:2140. In one aspect, provided herein is an antibody that binds TRDV2, comprising a VH having an amino acid sequence of SEQ ID NO:2139. In one aspect, provided herein is an antibody that binds TRDV2, comprising a VL having an amino acid sequence of SEQ ID NO:2140. In one aspect, provided herein is an antibody that binds TRDV2, comprising a VH having an amino acid sequence of SEQ ID NO:2139, and a VL having an amino acid sequence of SEQ ID NO:2140. In one aspect, provided herein is an antibody that binds TRDV2, comprising a heavy chain having an amino acid sequence of SEQ ID NO:2141. In one aspect, provided herein is an antibody that binds TRDV2, comprising a light chain having an amino acid sequence of SEQ ID NO:2142. In one aspect, provided herein is an antibody that binds TRDV2, comprising a heavy chain having an amino acid sequence of SEQ ID NO:2141, and a light chain having an amino acid sequence of SEQ ID NO:2142. In one aspect, provided herein is an antibody that binds TRDV2, comprising a VH having an amino acid sequence having at least 95% identity to an amino acid sequence of SEQ ID NO:2139. In one aspect, provided herein is an antibody that binds TRDV2, comprising a VL having an amino acid sequence having at least 95% identity to an amino acid sequence of SEQ ID NO:2140. In one aspect, provided herein is an antibody that binds TRDV2, comprising a VH having an amino acid sequence having at least 95% identity to an amino acid sequence of SEQ ID NO:2139, and a VL having an amino acid sequence having at least 95% identity to an amino acid sequence of SEQ ID NO:2140. In one aspect, provided herein is an antibody that binds TRDV2, comprising a heavy chain having an amino acid sequence having at least 95% identity to an amino acid sequence of SEQ ID NO:2141. In one aspect, provided herein is an antibody that binds TRDV2, comprising a light chain having an amino acid sequence having at least 95% identity to an amino acid sequence of SEQ ID NO:2142. In one aspect, provided herein is an antibody that binds TRDV2, comprising a heavy chain having an amino acid sequence having at least 95% identity to an amino acid sequence of SEQ ID NO:2141, and a light chain having an amino acid sequence having at least 95% identity to an amino acid sequence of SEQ ID NO:2142.

In one aspect, provided herein is an antibody that binds TRDV2, comprising: (i) a VH comprising a VH CDR1, a VH CDR2, and a VH CDR3 having an amino acid sequence of SEQ ID NOs:2143, 2144, and 2145, respectively, and (ii) a VL comprising a VL CDR1, VL CDR2, and VL CDR3 having an amino acid sequence of SEQ ID NOs:2146, 2147, and 2148, respectively. In one aspect, provided herein is an antibody that binds TRDV2, comprising: (i) a VH comprising a VH CDR1, a VH CDR2, and a VH CDR3 having an amino acid sequence of SEQ ID NOs:2149, 2150, and 2151, respectively, and (ii) a VL comprising a VL CDR1, VL CDR2, and VL CDR3 having an amino acid sequence of SEQ ID NOs:2152, 2153, and 2154, respectively. In one aspect, provided herein is an antibody that binds TRDV2, comprising: (i) a VH comprising a VH CDR1, a VH CDR2, and a VH CDR3 having an amino acid sequence of SEQ ID NOs:2155, 2156, and 2157, respectively, and (ii) a VL comprising a VL CDR1, VL CDR2, and VL CDR3 having an amino acid sequence of SEQ ID NOs:2158, 2159, and 2160, respectively. In one aspect, provided herein is an antibody that binds TRDV2, comprising: (i) a VH comprising a VH CDR1, a VH CDR2, and a VH CDR3 having an amino acid sequence of SEQ ID NOs:2161, 2162, and 2163, respectively, and (ii) a VL comprising a VL CDR1, VL CDR2, and VL CDR3 having an amino acid sequence of SEQ ID NOs:2164, 2165, and 2166, respectively. In one aspect, provided herein is an antibody that binds TRDV2, comprising: (i) a VH comprising a VH CDR1, a VH CDR2, and a VH CDR3 having an amino acid sequence of SEQ ID NOs:2167, 2168, and 2169, respectively, and (ii) a VL comprising a VL CDR1, VL CDR2, and VL CDR3 having an amino acid sequence of SEQ ID NOs:2170, 2171, and 2172, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of SEQ ID NO:2174. In one aspect, provided herein is an antibody that binds TRDV2, comprising a VH having an amino acid sequence of SEQ ID NO:2173. In one aspect, provided herein is an antibody that binds TRDV2, comprising a VL having an amino acid sequence of SEQ ID NO:2174. In one aspect, provided herein is an antibody that binds TRDV2, comprising a VH having an amino acid sequence of SEQ ID NO:2173, and a VL having an amino acid sequence of SEQ ID NO:2174. In one aspect, provided herein is an antibody that binds TRDV2, comprising a heavy chain having an amino acid sequence of SEQ ID NO:2175. In one aspect, provided herein is an antibody that binds TRDV2, comprising a light chain having an amino acid sequence of SEQ ID NO:2176. In one aspect, provided herein is an antibody that binds TRDV2, comprising a heavy chain having an amino acid sequence of SEQ ID NO:2175, and a light chain having an amino acid sequence of SEQ ID NO:2176. In one aspect, provided herein is an antibody that binds TRDV2, comprising a VH having an amino acid sequence having at least 95% identity to an amino acid sequence of SEQ ID NO:2173. In one aspect, provided herein is an antibody that binds TRDV2, comprising a VL having an amino acid sequence having at least 95% identity to an amino acid sequence of SEQ ID NO:2174. In one aspect, provided herein is an antibody that binds TRDV2, comprising a VH having an amino acid sequence having at least 95% identity to an amino acid sequence of SEQ ID NO:2173, and a VL having an amino acid sequence having at least 95% identity to an amino acid sequence of SEQ ID NO:2174. In one aspect, provided herein is an antibody that binds TRDV2, comprising a heavy chain having an amino acid sequence having at least 95% identity to an amino acid sequence of SEQ ID NO:2175. In one aspect, provided herein is an antibody that binds TRDV2, comprising a light chain having an amino acid sequence having at least 95% identity to an amino acid sequence of SEQ ID NO:2176. In one aspect, provided herein is an antibody that binds TRDV2, comprising a heavy chain having an amino acid sequence having at least 95% identity to an amino acid sequence of SEQ ID NO:2175, and a light chain having an amino acid sequence having at least 95% identity to an amino acid sequence of SEQ ID NO:2176.

In one aspect, provided herein is an antibody that binds TRDV2, comprising: (i) a VH comprising a VH CDR1, a VH CDR2, and a VH CDR3 having an amino acid sequence of SEQ ID NOs:2177, 2178, and 2179, respectively, and (ii) a VL comprising a VL CDR1, VL CDR2, and VL CDR3 having an amino acid sequence of SEQ ID NOs:2180, 2181, and 2182, respectively. In one aspect, provided herein is an antibody that binds TRDV2, comprising: (i) a VH comprising a VH CDR1, a VH CDR2, and a VH CDR3 having an amino acid sequence of SEQ ID NOs:2183, 2184, and 2185, respectively, and (ii) a VL comprising a VL CDR1, VL CDR2, and VL CDR3 having an amino acid sequence of SEQ ID NOs:2186, 2187, and 2188, respectively. In one aspect, provided herein is an antibody that binds TRDV2, comprising: (i) a VH comprising a VH CDR1, a VH CDR2, and a VH CDR3 having an amino acid sequence of SEQ ID NOs:2189, 2190, and 2191, respectively, and (ii) a VL comprising a VL CDR1, VL CDR2, and VL CDR3 having an amino acid sequence of SEQ ID NOs:2192, 2193, and 2194, respectively. In one aspect, provided herein is an antibody that binds TRDV2, comprising: (i) a VH comprising a VH CDR1, a VH CDR2, and a VH CDR3 having an amino acid sequence of SEQ ID NOs:2195, 2196, and 2197, respectively, and (ii) a VL comprising a VL CDR1, VL CDR2, and VL CDR3 having an amino acid sequence of SEQ ID NOs:2198, 2199, and 2200, respectively. In one aspect, provided herein is an antibody that binds TRDV2, comprising: (i) a VH comprising a VH CDR1, a VH CDR2, and a VH CDR3 having an amino acid sequence of SEQ ID NOs:2201, 2202, and 2203, respectively, and (ii) a VL comprising a VL CDR1, VL CDR2, and VL CDR3 having an amino acid sequence of SEQ ID NOs:2204, 2205, and 2206, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2207; and (ii) a VL comprising a VL CDR1, a VL CDR2, and a VL CDR3 having an amino acid sequence of a VL CDR1, a VL CDR2, and a VL CDR3, respectively, of SEQ ID NO:2208. In one aspect, provided herein is an antibody that binds TRDV2, comprising a VH having an amino acid sequence of SEQ ID NO:2207. In one aspect, provided herein is an antibody that binds TRDV2, comprising a VL having an amino acid sequence of SEQ ID NO:2208. In one aspect, provided herein is an antibody that binds TRDV2, comprising a VH having an amino acid sequence of SEQ ID NO:2207, and a VL having an amino acid sequence of SEQ ID NO:2208. In one aspect, provided herein is an antibody that binds TRDV2, comprising a heavy chain having an amino acid sequence of SEQ ID NO:2209. In one aspect, provided herein is an antibody that binds TRDV2, comprising a light chain having an amino acid sequence of SEQ ID NO:2210. In one aspect, provided herein is an antibody that binds TRDV2, comprising a heavy chain having an amino acid sequence of SEQ ID NO:2209, and a light chain having an amino acid sequence of SEQ ID NO:2210. In one aspect, provided herein is an antibody that binds TRDV2, comprising a VH having an amino acid sequence having at least 95% identity to an amino acid sequence of SEQ ID NO:2207. In one aspect, provided herein is an antibody that binds TRDV2, comprising a VL having an amino acid sequence having at least 95% identity to an amino acid sequence of SEQ ID NO:2208. In one aspect, provided herein is an antibody that binds TRDV2, comprising a VH having an amino acid sequence having at least 95% identity to an amino acid sequence of SEQ ID NO:2207, and a VL having an amino acid sequence having at least 95% identity to an amino acid sequence of SEQ ID NO:2208. In one aspect, provided herein is an antibody that binds TRDV2, comprising a heavy chain having an amino acid sequence having at least 95% identity to an amino acid sequence of SEQ ID NO:2209. In one aspect, provided herein is an antibody that binds TRDV2, comprising a light chain having an amino acid sequence having at least 95% identity to an amino acid sequence of SEQ ID NO:2210. In one aspect, provided herein is an antibody that binds TRDV2, comprising a heavy chain having an amino acid sequence having at least 95% identity to an amino acid sequence of SEQ ID NO:2209, and a light chain having an amino acid sequence having at least 95% identity to an amino acid sequence of SEQ ID NO:2210.

In one aspect, provided herein is an antibody that binds TRDV2, comprising: (i) a VH comprising a VH CDR1, a VH CDR2, and a VH CDR3 having an amino acid sequence of SEQ ID NOs:2211, 2212, and 2213, respectively, and (ii) a VL comprising a VL CDR1, VL CDR2, and VL CDR3 having an amino acid sequence of SEQ ID NOs:2214, 2215, and 2216, respectively. In one aspect, provided herein is an antibody that binds TRDV2, comprising: (i) a VH comprising a VH CDR1, a VH CDR2, and a VH CDR3 having an amino acid sequence of SEQ ID NOs:2217, 2218, and 2219, respectively, and (ii) a VL comprising a VL CDR1, VL CDR2, and VL CDR3 having an amino acid sequence of SEQ ID NOs:2220, 2221, and 2222, respectively. In one aspect, provided herein is an antibody that binds TRDV2, comprising: (i) a VH comprising a VH CDR1, a VH CDR2, and a VH CDR3 having an amino acid sequence of SEQ ID NOs:2223, 2224, and 2225, respectively, and (ii) a VL comprising a VL CDR1, VL CDR2, and VL CDR3 having an amino acid sequence of SEQ ID NOs:2226, 2227, and 2228, respectively. In one aspect, provided herein is an antibody that binds TRDV2, comprising: (i) a VH comprising a VH CDR1, a VH CDR2, and a VH CDR3 having an amino acid sequence of SEQ ID NOs:2229, 2230, and 2231, respectively, and (ii) a VL comprising a VL CDR1, VL CDR2, and VL CDR3 having an amino acid sequence of SEQ ID NOs:2232, 2233, and 2234, respectively. In one aspect, provided herein is an antibody that binds TRDV2, comprising: (i) a VH comprising a VH CDR1, a VH CDR2, and a VH CDR3 having an amino acid sequence of SEQ ID NOs:2235, 2236, and 2237, respectively, and (ii) a VL comprising a VL CDR1, VL CDR2, and VL CDR3 having an amino acid sequence of SEQ ID NOs:2238, 2239, and 2240, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2241; and (ii) a VL comprising a VL CDR1, a VL CDR2, and a VL CDR3 having an amino acid sequence of a VL CDR1, a VL CDR2, and a VL CDR3, respectively, of SEQ ID NO:2242. In one aspect, provided herein is an antibody that binds TRDV2, comprising a VH having an amino acid sequence of SEQ ID NO:2241. In one aspect, provided herein is an antibody that binds TRDV2, comprising a VL having an amino acid sequence of SEQ ID NO:2242. In one aspect, provided herein is an antibody that binds TRDV2, comprising a VH having an amino acid sequence of SEQ ID NO:2241, and a VL having an amino acid sequence of SEQ ID NO:2242. In one aspect, provided herein is an antibody that binds TRDV2, comprising a heavy chain having an amino acid sequence of SEQ ID NO:2243. In one aspect, provided herein is an antibody that binds TRDV2, comprising a light chain having an amino acid sequence of SEQ ID NO:2244. In one aspect, provided herein is an antibody that binds TRDV2, comprising a heavy chain having an amino acid sequence of SEQ ID NO:2243, and a light chain having an amino acid sequence of SEQ ID NO:2244. In one aspect, provided herein is an antibody that binds TRDV2, comprising a VH having an amino acid sequence having at least 95% identity to an amino acid sequence of SEQ ID NO:2241. In one aspect, provided herein is an antibody that binds TRDV2, comprising a VL having an amino acid sequence having at least 95% identity to an amino acid sequence of SEQ ID NO:2242. In one aspect, provided herein is an antibody that binds TRDV2, comprising a VH having an amino acid sequence having at least 95% identity to an amino acid sequence of SEQ ID NO:2241, and a VL having an amino acid sequence having at least 95% identity to an amino acid sequence of SEQ ID NO:2242. In one aspect, provided herein is an antibody that binds TRDV2, comprising a heavy chain having an amino acid sequence having at least 95% identity to an amino acid sequence of SEQ ID NO:2243. In one aspect, provided herein is an antibody that binds TRDV2, comprising a light chain having an amino acid sequence having at least 95% identity to an amino acid sequence of SEQ ID NO:2244. In one aspect, provided herein is an antibody that binds TRDV2, comprising a heavy chain having an amino acid sequence having at least 95% identity to an amino acid sequence of SEQ ID NO:2243, and a light chain having an amino acid sequence having at least 95% identity to an amino acid sequence of SEQ ID NO:2244.

In one aspect, provided herein is an antibody that binds TRDV2, comprising: (i) a VH comprising a VH CDR1, a VH CDR2, and a VH CDR3 having an amino acid sequence of SEQ ID NOs:2245, 2246, and 2247, respectively, and (ii) a VL comprising a VL CDR1, VL CDR2, and VL CDR3 having an amino acid sequence of SEQ ID NOs:2248, 2249, and 2250, respectively. In one aspect, provided herein is an antibody that binds TRDV2, comprising: (i) a VH comprising a VH CDR1, a VH CDR2, and a VH CDR3 having an amino acid sequence of SEQ ID NOs:2251, 2252, and 2253, respectively, and (ii) a VL comprising a VL CDR1, VL CDR2, and VL CDR3 having an amino acid sequence of SEQ ID NOs:2254, 2255, and 2256, respectively. In one aspect, provided herein is an antibody that binds TRDV2, comprising: (i) a VH comprising a VH CDR1, a VH CDR2, and a VH CDR3 having an amino acid sequence of SEQ ID NOs:2257, 2258, and 2259, respectively, and (ii) a VL comprising a VL CDR1, VL CDR2, and VL CDR3 having an amino acid sequence of SEQ ID NOs:2260, 2261, and 2262, respectively. In one aspect, provided herein is an antibody that binds TRDV2, comprising: (i) a VH comprising a VH CDR1, a VH CDR2, and a VH CDR3 having an amino acid sequence of SEQ ID NOs:2263, 2264, and 2265, respectively, and (ii) a VL comprising a VL CDR1, VL CDR2, and VL CDR3 having an amino acid sequence of SEQ ID NOs:2266, 2267, and 2268, respectively. In one aspect, provided herein is an antibody that binds TRDV2, comprising: (i) a VH comprising a VH CDR1, a VH CDR2, and a VH CDR3 having an amino acid sequence of SEQ ID NOs:2269, 2270, and 2271, respectively, and (ii) a VL comprising a VL CDR1, VL CDR2, and VL CDR3 having an amino acid sequence of SEQ ID NOs:2272, 2273, and 2274, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2275; and (ii) a VL comprising a VL CDR1, a VL CDR2, and a VL CDR3 having an amino acid sequence of a VL CDR1, a VL CDR2, and a VL CDR3, respectively, of SEQ ID NO:2276. In one aspect, provided herein is an antibody that binds TRDV2, comprising a VH having an amino acid sequence of SEQ ID NO:2275. In one aspect, provided herein is an antibody that binds TRDV2, comprising a VL having an amino acid sequence of SEQ ID NO:2276. In one aspect, provided herein is an antibody that binds TRDV2, comprising a VH having an amino acid sequence of SEQ ID NO:2275, and a VL having an amino acid sequence of SEQ ID NO:2276. In one aspect, provided herein is an antibody that binds TRDV2, comprising a heavy chain having an amino acid sequence of SEQ ID NO:2277. In one aspect, provided herein is an antibody that binds TRDV2, comprising a light chain having an amino acid sequence of SEQ ID NO:2278. In one aspect, provided herein is an antibody that binds TRDV2, comprising a heavy chain having an amino acid sequence of SEQ ID NO:2277, and a light chain having an amino acid sequence of SEQ ID NO:2278. In one aspect, provided herein is an antibody that binds TRDV2, comprising a VH having an amino acid sequence having at least 95% identity to an amino acid sequence of SEQ ID NO:2275. In one aspect, provided herein is an antibody that binds TRDV2, comprising a VL having an amino acid sequence having at least 95% identity to an amino acid sequence of SEQ ID NO:2276. In one aspect, provided herein is an antibody that binds TRDV2, comprising a VH having an amino acid sequence having at least 95% identity to an amino acid sequence of SEQ ID NO:2275, and a VL having an amino acid sequence having at least 95% identity to an amino acid sequence of SEQ ID NO:2276. In one aspect, provided herein is an antibody that binds TRDV2, comprising a heavy chain having an amino acid sequence having at least 95% identity to an amino acid sequence of SEQ ID NO:2277. In one aspect, provided herein is an antibody that binds TRDV2, comprising a light chain having an amino acid sequence having at least 95% identity to an amino acid sequence of SEQ ID NO:2278. In one aspect, provided herein is an antibody that binds TRDV2, comprising a heavy chain having an amino acid sequence having at least 95% identity to an amino acid sequence of SEQ ID NO:2277, and a light chain having an amino acid sequence having at least 95% identity to an amino acid sequence of SEQ ID NO:2278.

In one aspect, provided herein is an antibody that binds TRDV2, comprising: (i) a VH comprising a VH CDR1, a VH CDR2, and a VH CDR3 having an amino acid sequence of SEQ ID NOs:2279, 2280, and 2281, respectively, and (ii) a VL comprising a VL CDR1, VL CDR2, and VL CDR3 having an amino acid sequence of SEQ ID NOs:2282, 2283, and 2284, respectively. In one aspect, provided herein is an antibody that binds TRDV2, comprising: (i) a VH comprising a VH CDR1, a VH CDR2, and a VH CDR3 having an amino acid sequence of SEQ ID NOs:2285, 2286, and 2287, respectively, and (ii) a VL comprising a VL CDR1, VL CDR2, and VL CDR3 having an amino acid sequence of SEQ ID NOs:2288, 2289, and 2290, respectively. In one aspect, provided herein is an antibody that binds TRDV2, comprising: (i) a VH comprising a VH CDR1, a VH CDR2, and a VH CDR3 having an amino acid sequence of SEQ ID NOs:2291, 2292, and 2293, respectively, and (ii) a VL comprising a VL CDR1, VL CDR2, and VL CDR3 having an amino acid sequence of SEQ ID NOs:2294, 2295, and 2296, respectively. In one aspect, provided herein is an antibody that binds TRDV2, comprising: (i) a VH comprising a VH CDR1, a VH CDR2, and a VH CDR3 having an amino acid sequence of SEQ ID NOs:2297, 2298, and 2299, respectively, and (ii) a VL comprising a VL CDR1, VL CDR2, and VL CDR3 having an amino acid sequence of SEQ ID NOs:2300, 2301, and 2302, respectively. In one aspect, provided herein is an antibody that binds TRDV2, comprising: (i) a VH comprising a VH CDR1, a VH CDR2, and a VH CDR3 having an amino acid sequence of SEQ ID NOs:2303, 2304, and 2305, respectively, and (ii) a VL comprising a VL CDR1, VL CDR2, and VL CDR3 having an amino acid sequence of SEQ ID NOs:2306, 2307, and 2308, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2309; and (ii) a VL comprising a VL CDR1, a VL CDR2, and a VL CDR3 having an amino acid sequence of a VL CDR1, a VL CDR2, and a VL CDR3, respectively, of SEQ ID NO:2310. In one aspect, provided herein is an antibody that binds TRDV2, comprising a VH having an amino acid sequence of SEQ ID NO:2309. In one aspect, provided herein is an antibody that binds TRDV2, comprising a VL having an amino acid sequence of SEQ ID NO:2310. In one aspect, provided herein is an antibody that binds TRDV2, comprising a VH having an amino acid sequence of SEQ ID NO:2309, and a VL having an amino acid sequence of SEQ ID NO:2310. In one aspect, provided herein is an antibody that binds TRDV2, comprising a heavy chain having an amino acid sequence of SEQ ID NO:2311. In one aspect, provided herein is an antibody that binds TRDV2, comprising a light chain having an amino acid sequence of SEQ ID NO:2312. In one aspect, provided herein is an antibody that binds TRDV2, comprising a heavy chain having an amino acid sequence of SEQ ID NO:2311, and a light chain having an amino acid sequence of SEQ ID NO:2312. In one aspect, provided herein is an antibody that binds TRDV2, comprising a VH having an amino acid sequence having at least 95% identity to an amino acid sequence of SEQ ID NO:2309. In one aspect, provided herein is an antibody that binds TRDV2, comprising a VL having an amino acid sequence having at least 95% identity to an amino acid sequence of SEQ ID NO:2310. In one aspect, provided herein is an antibody that binds TRDV2, comprising a VH having an amino acid sequence having at least 95% identity to an amino acid sequence of SEQ ID NO:2309, and a VL having an amino acid sequence having at least 95% identity to an amino acid sequence of SEQ ID NO:2310. In one aspect, provided herein is an antibody that binds TRDV2, comprising a heavy chain having an amino acid sequence having at least 95% identity to an amino acid sequence of SEQ ID NO:2311. In one aspect, provided herein is an antibody that binds TRDV2, comprising a light chain having an amino acid sequence having at least 95% identity to an amino acid sequence of SEQ ID NO:2312. In one aspect, provided herein is an antibody that binds TRDV2, comprising a heavy chain having an amino acid sequence having at least 95% identity to an amino acid sequence of SEQ ID NO:2311, and a light chain having an amino acid sequence having at least 95% identity to an amino acid sequence of SEQ ID NO:2312.

In one aspect, provided herein is an antibody that binds TRDV2, comprising: (i) a VH comprising a VH CDR1, a VH CDR2, and a VH CDR3 having an amino acid sequence of SEQ ID NOs:2313, 2314, and 2315, respectively, and (ii) a VL comprising a VL CDR1, VL CDR2, and VL CDR3 having an amino acid sequence of SEQ ID NOs:2316, 2317, and 2318, respectively. In one aspect, provided herein is an antibody that binds TRDV2, comprising: (i) a VH comprising a VH CDR1, a VH CDR2, and a VH CDR3 having an amino acid sequence of SEQ ID NOs:2319, 2320, and 2321, respectively, and (ii) a VL comprising a VL CDR1, VL CDR2, and VL CDR3 having an amino acid sequence of SEQ ID NOs:2322, 2323, and 2324, respectively. In one aspect, provided herein is an antibody that binds TRDV2, comprising: (i) a VH comprising a VH CDR1, a VH CDR2, and a VH CDR3 having an amino acid sequence of SEQ ID NOs:2325, 2326, and 2327, respectively, and (ii) a VL comprising a VL CDR1, VL CDR2, and VL CDR3 having an amino acid sequence of SEQ ID NOs:2328, 2329, and 2330, respectively. In one aspect, provided herein is an antibody that binds TRDV2, comprising: (i) a VH comprising a VH CDR1, a VH CDR2, and a VH CDR3 having an amino acid sequence of SEQ ID NOs:2331, 2332, and 2333, respectively, and (ii) a VL comprising a VL CDR1, VL CDR2, and VL CDR3 having an amino acid sequence of SEQ ID NOs:2334, 2335, and 2336, respectively. In one aspect, provided herein is an antibody that binds TRDV2, comprising: (i) a VH comprising a VH CDR1, a VH CDR2, and a VH CDR3 having an amino acid sequence of SEQ ID NOs:2337, 2338, and 2339, respectively, and (ii) a VL comprising a VL CDR1, VL CDR2, and VL CDR3 having an amino acid sequence of SEQ ID NOs:2340, 2341, and 2342, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2343; and (ii) a VL comprising a VL CDR1, a VL CDR2, and a VL CDR3 having an amino acid sequence of a VL CDR1, a VL CDR2, and a VL CDR3, respectively, of SEQ ID NO:2344. In one aspect, provided herein is an antibody that binds TRDV2, comprising a VH having an amino acid sequence of SEQ ID NO:2343. In one aspect, provided herein is an antibody that binds TRDV2, comprising a VL having an amino acid sequence of SEQ ID NO:2344. In one aspect, provided herein is an antibody that binds TRDV2, comprising a VH having an amino acid sequence of SEQ ID NO:2343, and a VL having an amino acid sequence of SEQ ID NO:2344. In one aspect, provided herein is an antibody that binds TRDV2, comprising a heavy chain having an amino acid sequence of SEQ ID NO:2345. In one aspect, provided herein is an antibody that binds TRDV2, comprising a light chain having an amino acid sequence of SEQ ID NO:2346. In one aspect, provided herein is an antibody that binds TRDV2, comprising a heavy chain having an amino acid sequence of SEQ ID NO:2345, and a light chain having an amino acid sequence of SEQ ID NO:2346. In one aspect, provided herein is an antibody that binds TRDV2, comprising a VH having an amino acid sequence having at least 95% identity to an amino acid sequence of SEQ ID NO:2343. In one aspect, provided herein is an antibody that binds TRDV2, comprising a VL having an amino acid sequence having at least 95% identity to an amino acid sequence of SEQ ID NO:2344. In one aspect, provided herein is an antibody that binds TRDV2, comprising a VH having an amino acid sequence having at least 95% identity to an amino acid sequence of SEQ ID NO:2343, and a VL having an amino acid sequence having at least 95% identity to an amino acid sequence of SEQ ID NO:2344. In one aspect, provided herein is an antibody that binds TRDV2, comprising a heavy chain having an amino acid sequence having at least 95% identity to an amino acid sequence of SEQ ID NO:2345. In one aspect, provided herein is an antibody that binds TRDV2, comprising a light chain having an amino acid sequence having at least 95% identity to an amino acid sequence of SEQ ID NO:2346. In one aspect, provided herein is an antibody that binds TRDV2, comprising a heavy chain having an amino acid sequence having at least 95% identity to an amino acid sequence of SEQ ID NO:2345, and a light chain having an amino acid sequence having at least 95% identity to an amino acid sequence of SEQ ID NO:2346.

In one aspect, provided herein is an antibody that binds TRDV2, comprising: (i) a VH comprising a VH CDR1, a VH CDR2, and a VH CDR3 having an amino acid sequence of SEQ ID NOs:2347, 2348, and 2349, respectively, and (ii) a VL comprising a VL CDR1, VL CDR2, and VL CDR3 having an amino acid sequence of SEQ ID NOs:2350, 2351, and 2352, respectively. In one aspect, provided herein is an antibody that binds TRDV2, comprising: (i) a VH comprising a VH CDR1, a VH CDR2, and a VH CDR3 having an amino acid sequence of SEQ ID NOs:2353, 2354, and 2355, respectively, and (ii) a VL comprising a VL CDR1, VL CDR2, and VL CDR3 having an amino acid sequence of SEQ ID NOs:2356, 2357, and 2358, respectively. In one aspect, provided herein is an antibody that binds TRDV2, comprising: (i) a VH comprising a VH CDR1, a VH CDR2, and a VH CDR3 having an amino acid sequence of SEQ ID NOs:2359, 2360, and 2361, respectively, and (ii) a VL comprising a VL CDR1, VL CDR2, and VL CDR3 having an amino acid sequence of SEQ ID NOs:2362, 2363, and 2364, respectively. In one aspect, provided herein is an antibody that binds TRDV2, comprising: (i) a VH comprising a VH CDR1, a VH CDR2, and a VH CDR3 having an amino acid sequence of SEQ ID NOs:2365, 2366, and 2367, respectively, and (ii) a VL comprising a VL CDR1, VL CDR2, and VL CDR3 having an amino acid sequence of SEQ ID NOs:2368, 2369, and 2370, respectively. In one aspect, provided herein is an antibody that binds TRDV2, comprising: (i) a VH comprising a VH CDR1, a VH CDR2, and a VH CDR3 having an amino acid sequence of SEQ ID NOs:2371, 2372, and 2373, respectively, and (ii) a VL comprising a VL CDR1, VL CDR2, and VL CDR3 having an amino acid sequence of SEQ ID NOs:2374, 2375, and 2376, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2377; and (ii) a VL comprising a VL CDR1, a VL CDR2, and a VL CDR3 having an amino acid sequence of a VL CDR1, a VL CDR2, and a VL CDR3, respectively, of SEQ ID NO:2378. In one aspect, provided herein is an antibody that binds TRDV2, comprising a VH having an amino acid sequence of SEQ ID NO:2377. In one aspect, provided herein is an antibody that binds TRDV2, comprising a VL having an amino acid sequence of SEQ ID NO:2378. In one aspect, provided herein is an antibody that binds TRDV2, comprising a VH having an amino acid sequence of SEQ ID NO:2377, and a VL having an amino acid sequence of SEQ ID NO:2378. In one aspect, provided herein is an antibody that binds TRDV2, comprising a heavy chain having an amino acid sequence of SEQ ID NO:2379. In one aspect, provided herein is an antibody that binds TRDV2, comprising a light chain having an amino acid sequence of SEQ ID NO:2380. In one aspect, provided herein is an antibody that binds TRDV2, comprising a heavy chain having an amino acid sequence of SEQ ID NO:2379, and a light chain having an amino acid sequence of SEQ ID NO:2380. In one aspect, provided herein is an antibody that binds TRDV2, comprising a VH having an amino acid sequence having at least 95% identity to an amino acid sequence of SEQ ID NO:2377. In one aspect, provided herein is an antibody that binds TRDV2, comprising a VL having an amino acid sequence having at least 95% identity to an amino acid sequence of SEQ ID NO:2378. In one aspect, provided herein is an antibody that binds TRDV2, comprising a VH having an amino acid sequence having at least 95% identity to an amino acid sequence of SEQ ID NO:2377, and a VL having an amino acid sequence having at least 95% identity to an amino acid sequence of SEQ ID NO:2378. In one aspect, provided herein is an antibody that binds TRDV2, comprising a heavy chain having an amino acid sequence having at least 95% identity to an amino acid sequence of SEQ ID NO:2379. In one aspect, provided herein is an antibody that binds TRDV2, comprising a light chain having an amino acid sequence having at least 95% identity to an amino acid sequence of SEQ ID NO:2380. In one aspect, provided herein is an antibody that binds TRDV2, comprising a heavy chain having an amino acid sequence having at least 95% identity to an amino acid sequence of SEQ ID NO:2379, and a light chain having an amino acid sequence having at least 95% identity to an amino acid sequence of SEQ ID NO:2380.

In one aspect, provided herein is an antibody that binds TRDV2, comprising: (i) a VH comprising a VH CDR1, a VH CDR2, and a VH CDR3 having an amino acid sequence of SEQ ID NOs:2381, 2382, and 2383, respectively, and (ii) a VL comprising a VL CDR1, VL CDR2, and VL CDR3 having an amino acid sequence of SEQ ID NOs:2384, 2385, and 2386, respectively. In one aspect, provided herein is an antibody that binds TRDV2, comprising: (i) a VH comprising a VH CDR1, a VH CDR2, and a VH CDR3 having an amino acid sequence of SEQ ID NOs:2387, 2388, and 2389, respectively, and (ii) a VL comprising a VL CDR1, VL CDR2, and VL CDR3 having an amino acid sequence of SEQ ID NOs:2390, 2391, and 2392, respectively. In one aspect, provided herein is an antibody that binds TRDV2, comprising: (i) a VH comprising a VH CDR1, a VH CDR2, and a VH CDR3 having an amino acid sequence of SEQ ID NOs:2393, 2394, and 2395, respectively, and (ii) a VL comprising a VL CDR1, VL CDR2, and VL CDR3 having an amino acid sequence of SEQ ID NOs:2396, 2397, and 2398, respectively. In one aspect, provided herein is an antibody that binds TRDV2, comprising: (i) a VH comprising a VH CDR1, a VH CDR2, and a VH CDR3 having an amino acid sequence of SEQ ID NOs:2399, 2400, and 2401, respectively, and (ii) a VL comprising a VL CDR1, VL CDR2, and VL CDR3 having an amino acid sequence of SEQ ID NOs:2402, 2403, and 2404, respectively. In one aspect, provided herein is an antibody that binds TRDV2, comprising: (i) a VH comprising a VH CDR1, a VH CDR2, and a VH CDR3 having an amino acid sequence of SEQ ID NOs:2405, 2406, and 2407, respectively, and (ii) a VL comprising a VL CDR1, VL CDR2, and VL CDR3 having an amino acid sequence of SEQ ID NOs:2408, 2409, and 2410, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2411; and (ii) a VL comprising a VL CDR1, a VL CDR2, and a VL CDR3 having an amino acid sequence of a VL CDR1, a VL CDR2, and a VL CDR3, respectively, of SEQ ID NO:2412. In one aspect, provided herein is an antibody that binds TRDV2, comprising a VH having an amino acid sequence of SEQ ID NO:2411. In one aspect, provided herein is an antibody that binds TRDV2, comprising a VL having an amino acid sequence of SEQ ID NO:2412. In one aspect, provided herein is an antibody that binds TRDV2, comprising a VH having an amino acid sequence of SEQ ID NO:2411, and a VL having an amino acid sequence of SEQ ID NO:2412. In one aspect, provided herein is an antibody that binds TRDV2, comprising a heavy chain having an amino acid sequence of SEQ ID NO:2413. In one aspect, provided herein is an antibody that binds TRDV2, comprising a light chain having an amino acid sequence of SEQ ID NO:2414. In one aspect, provided herein is an antibody that binds TRDV2, comprising a heavy chain having an amino acid sequence of SEQ ID NO:2413, and a light chain having an amino acid sequence of SEQ ID NO:2414. In one aspect, provided herein is an antibody that binds TRDV2, comprising a VH having an amino acid sequence having at least 95% identity to an amino acid sequence of SEQ ID NO:2411. In one aspect, provided herein is an antibody that binds TRDV2, comprising a VL having an amino acid sequence having at least 95% identity to an amino acid sequence of SEQ ID NO:2412. In one aspect, provided herein is an antibody that binds TRDV2, comprising a VH having an amino acid sequence having at least 95% identity to an amino acid sequence of SEQ ID NO:2411, and a VL having an amino acid sequence having at least 95% identity to an amino acid sequence of SEQ ID NO:2412. In one aspect, provided herein is an antibody that binds TRDV2, comprising a heavy chain having an amino acid sequence having at least 95% identity to an amino acid sequence of SEQ ID NO:2413. In one aspect, provided herein is an antibody that binds TRDV2, comprising a light chain having an amino acid sequence having at least 95% identity to an amino acid sequence of SEQ ID NO:2414. In one aspect, provided herein is an antibody that binds TRDV2, comprising a heavy chain having an amino acid sequence having at least 95% identity to an amino acid sequence of SEQ ID NO:2413, and a light chain having an amino acid sequence having at least 95% identity to an amino acid sequence of SEQ ID NO:2414.

In one aspect, provided herein is an antibody that binds TRDV2, comprising: (i) a VH comprising a VH CDR1, a VH CDR2, and a VH CDR3 having an amino acid sequence of SEQ ID NOs:2415, 2416, and 2417, respectively, and (ii) a VL comprising a VL CDR1, VL CDR2, and VL CDR3 having an amino acid sequence of SEQ ID NOs:2418, 2419, and 2420, respectively. In one aspect, provided herein is an antibody that binds TRDV2, comprising: (i) a VH comprising a VH CDR1, a VH CDR2, and a VH CDR3 having an amino acid sequence of SEQ ID NOs:2421, 2422, and 2423, respectively, and (ii) a VL comprising a VL CDR1, VL CDR2, and VL CDR3 having an amino acid sequence of SEQ ID NOs:2424, 2425, and 2426, respectively. In one aspect, provided herein is an antibody that binds TRDV2, comprising: (i) a VH comprising a VH CDR1, a VH CDR2, and a VH CDR3 having an amino acid sequence of SEQ ID NOs:2427, 2428, and 2429, respectively, and (ii) a VL comprising a VL CDR1, VL CDR2, and VL CDR3 having an amino acid sequence of SEQ ID NOs:2430, 2431, and 2432, respectively. In one aspect, provided herein is an antibody that binds TRDV2, comprising: (i) a VH comprising a VH CDR1, a VH CDR2, and a VH CDR3 having an amino acid sequence of SEQ ID NOs:2433, 2434, and 2435, respectively, and (ii) a VL comprising a VL CDR1, VL CDR2, and VL CDR3 having an amino acid sequence of SEQ ID NOs:2436, 2437, and 2438, respectively. In one aspect, provided herein is an antibody that binds TRDV2, comprising: (i) a VH comprising a VH CDR1, a VH CDR2, and a VH CDR3 having an amino acid sequence of SEQ ID NOs:2439, 2440, and 2441, respectively, and (ii) a VL comprising a VL CDR1, VL CDR2, and VL CDR3 having an amino acid sequence of SEQ ID NOs:2442, 2443, and 2444, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2445; and (ii) a VL comprising a VL CDR1, a VL CDR2, and a VL CDR3 having an amino acid sequence of a VL CDR1, a VL CDR2, and a VL CDR3, respectively, of SEQ ID NO:2446. In one aspect, provided herein is an antibody that binds TRDV2, comprising a VH having an amino acid sequence of SEQ ID NO:2445. In one aspect, provided herein is an antibody that binds TRDV2, comprising a VL having an amino acid sequence of SEQ ID NO:2446. In one aspect, provided herein is an antibody that binds TRDV2, comprising a VH having an amino acid sequence of SEQ ID NO:2445, and a VL having an amino acid sequence of SEQ ID NO:2446. In one aspect, provided herein is an antibody that binds TRDV2, comprising a heavy chain having an amino acid sequence of SEQ ID NO:2447. In one aspect, provided herein is an antibody that binds TRDV2, comprising a light chain having an amino acid sequence of SEQ ID NO:2448. In one aspect, provided herein is an antibody that binds TRDV2, comprising a heavy chain having an amino acid sequence of SEQ ID NO:2447, and a light chain having an amino acid sequence of SEQ ID NO:2448. In one aspect, provided herein is an antibody that binds TRDV2, comprising a VH having an amino acid sequence having at least 95% identity to an amino acid sequence of SEQ ID NO:2445. In one aspect, provided herein is an antibody that binds TRDV2, comprising a VL having an amino acid sequence having at least 95% identity to an amino acid sequence of SEQ ID NO:2446. In one aspect, provided herein is an antibody that binds TRDV2, comprising a VH having an amino acid sequence having at least 95% identity to an amino acid sequence of SEQ ID NO:2445, and a VL having an amino acid sequence having at least 95% identity to an amino acid sequence of SEQ ID NO:2446. In one aspect, provided herein is an antibody that binds TRDV2, comprising a heavy chain having an amino acid sequence having at least 95% identity to an amino acid sequence of SEQ ID NO:2447. In one aspect, provided herein is an antibody that binds TRDV2, comprising a light chain having an amino acid sequence having at least 95% identity to an amino acid sequence of SEQ ID NO:2448. In one aspect, provided herein is an antibody that binds TRDV2, comprising a heavy chain having an amino acid sequence having at least 95% identity to an amino acid sequence of SEQ ID NO:2447, and a light chain having an amino acid sequence having at least 95% identity to an amino acid sequence of SEQ ID NO:2448.

In one aspect, provided herein is an antibody that binds TRDV2, comprising: (i) a VH comprising a VH CDR1, a VH CDR2, and a VH CDR3 having an amino acid sequence of SEQ ID NOs:2449, 2450, and 2451, respectively, and (ii) a VL comprising a VL CDR1, VL CDR2, and VL CDR3 having an amino acid sequence of SEQ ID NOs:2452, 2453, and 2454, respectively. In one aspect, provided herein is an antibody that binds TRDV2, comprising: (i) a VH comprising a VH CDR1, a VH CDR2, and a VH CDR3 having an amino acid sequence of SEQ ID NOs:2455, 2456, and 2457, respectively, and (ii) a VL comprising a VL CDR1, VL CDR2, and VL CDR3 having an amino acid sequence of SEQ ID NOs:2458, 2459, and 2460, respectively. In one aspect, provided herein is an antibody that binds TRDV2, comprising: (i) a VH comprising a VH CDR1, a VH CDR2, and a VH CDR3 having an amino acid sequence of SEQ ID NOs:2461, 2462, and 2463, respectively, and (ii) a VL comprising a VL CDR1, VL CDR2, and VL CDR3 having an amino acid sequence of SEQ ID NOs:2464, 2465, and 2466, respectively. In one aspect, provided herein is an antibody that binds TRDV2, comprising: (i) a VH comprising a VH CDR1, a VH CDR2, and a VH CDR3 having an amino acid sequence of SEQ ID NOs:2467, 2468, and 2469, respectively, and (ii) a VL comprising a VL CDR1, VL CDR2, and VL CDR3 having an amino acid sequence of SEQ ID NOs:2470, 2471, and 2472, respectively. In one aspect, provided herein is an antibody that binds TRDV2, comprising: (i) a VH comprising a VH CDR1, a VH CDR2, and a VH CDR3 having an amino acid sequence of SEQ ID NOs:2473, 2474, and 2475, respectively, and (ii) a VL comprising a VL CDR1, VL CDR2, and VL CDR3 having an amino acid sequence of SEQ ID NOs:2476, 2477, and 2478, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2479; and (ii) a VL comprising a VL CDR1, a VL CDR2, and a VL CDR3 having an amino acid sequence of a VL CDR1, a VL CDR2, and a VL CDR3, respectively, of SEQ ID NO:2480. In one aspect, provided herein is an antibody that binds TRDV2, comprising a VH having an amino acid sequence of SEQ ID NO:2479. In one aspect, provided herein is an antibody that binds TRDV2, comprising a VL having an amino acid sequence of SEQ ID NO:2480. In one aspect, provided herein is an antibody that binds TRDV2, comprising a VH having an amino acid sequence of SEQ ID NO:2479, and a VL having an amino acid sequence of SEQ ID NO:2480. In one aspect, provided herein is an antibody that binds TRDV2, comprising a heavy chain having an amino acid sequence of SEQ ID NO:2481. In one aspect, provided herein is an antibody that binds TRDV2, comprising a light chain having an amino acid sequence of SEQ ID NO:2482. In one aspect, provided herein is an antibody that binds TRDV2, comprising a heavy chain having an amino acid sequence of SEQ ID NO:2481, and a light chain having an amino acid sequence of SEQ ID NO:2482. In one aspect, provided herein is an antibody that binds TRDV2, comprising a VH having an amino acid sequence having at least 95% identity to an amino acid sequence of SEQ ID NO:2479. In one aspect, provided herein is an antibody that binds TRDV2, comprising a VL having an amino acid sequence having at least 95% identity to an amino acid sequence of SEQ ID NO:2480. In one aspect, provided herein is an antibody that binds TRDV2, comprising a VH having an amino acid sequence having at least 95% identity to an amino acid sequence of SEQ ID NO:2479, and a VL having an amino acid sequence having at least 95% identity to an amino acid sequence of SEQ ID NO:2480. In one aspect, provided herein is an antibody that binds TRDV2, comprising a heavy chain having an amino acid sequence having at least 95% identity to an amino acid sequence of SEQ ID NO:2481. In one aspect, provided herein is an antibody that binds TRDV2, comprising a light chain having an amino acid sequence having at least 95% identity to an amino acid sequence of SEQ ID NO:2482. In one aspect, provided herein is an antibody that binds TRDV2, comprising a heavy chain having an amino acid sequence having at least 95% identity to an amino acid sequence of SEQ ID NO:2481, and a light chain having an amino acid sequence having at least 95% identity to an amino acid sequence of SEQ ID NO:2482.

In one aspect, provided herein is an antibody that binds TRDV2, comprising: (i) a VH comprising a VH CDR1, a VH CDR2, and a VH CDR3 having an amino acid sequence of SEQ ID NOs:2483, 2484, and 2485, respectively, and (ii) a VL comprising a VL CDR1, VL CDR2, and VL CDR3 having an amino acid sequence of SEQ ID NOs:2486, 2487, and 2488, respectively. In one aspect, provided herein is an antibody that binds TRDV2, comprising: (i) a VH comprising a VH CDR1, a VH CDR2, and a VH CDR3 having an amino acid sequence of SEQ ID NOs:2489, 2490, and 2491, respectively, and (ii) a VL comprising a VL CDR1, VL CDR2, and VL CDR3 having an amino acid sequence of SEQ ID NOs:2492, 2493, and 2494, respectively. In one aspect, provided herein is an antibody that binds TRDV2, comprising: (i) a VH comprising a VH CDR1, a VH CDR2, and a VH CDR3 having an amino acid sequence of SEQ ID NOs:2495, 2496, and 2497, respectively, and (ii) a VL comprising a VL CDR1, VL CDR2, and VL CDR3 having an amino acid sequence of SEQ ID NOs:2498, 2499, and 2500, respectively. In one aspect, provided herein is an antibody that binds TRDV2, comprising: (i) a VH comprising a VH CDR1, a VH CDR2, and a VH CDR3 having an amino acid sequence of SEQ ID NOs:2501, 2502, and 2503, respectively, and (ii) a VL comprising a VL CDR1, VL CDR2, and VL CDR3 having an amino acid sequence of SEQ ID NOs:2504, 2505, and 2506, respectively. In one aspect, provided herein is an antibody that binds TRDV2, comprising: (i) a VH comprising a VH CDR1, a VH CDR2, and a VH CDR3 having an amino acid sequence of SEQ ID NOs:2507, 2508, and 2509, respectively, and (ii) a VL comprising a VL CDR1, VL CDR2, and VL CDR3 having an amino acid sequence of SEQ ID NOs:2510, 2511, and 2512, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2513; and (ii) a VL comprising a VL CDR1, a VL CDR2, and a VL CDR3 having an amino acid sequence of a VL CDR1, a VL CDR2, and a VL CDR3, respectively, of SEQ ID NO:2514. In one aspect, provided herein is an antibody that binds TRDV2, comprising a VH having an amino acid sequence of SEQ ID NO:2513. In one aspect, provided herein is an antibody that binds TRDV2, comprising a VL having an amino acid sequence of SEQ ID NO:2514. In one aspect, provided herein is an antibody that binds TRDV2, comprising a VH having an amino acid sequence of SEQ ID NO:2513, and a VL having an amino acid sequence of SEQ ID NO:2514. In one aspect, provided herein is an antibody that binds TRDV2, comprising a heavy chain having an amino acid sequence of SEQ ID NO:2515. In one aspect, provided herein is an antibody that binds TRDV2, comprising a light chain having an amino acid sequence of SEQ ID NO:2516. In one aspect, provided herein is an antibody that binds TRDV2, comprising a heavy chain having an amino acid sequence of SEQ ID NO:2515, and a light chain having an amino acid sequence of SEQ ID NO:2516. In one aspect, provided herein is an antibody that binds TRDV2, comprising a VH having an amino acid sequence having at least 95% identity to an amino acid sequence of SEQ ID NO:2513. In one aspect, provided herein is an antibody that binds TRDV2, comprising a VL having an amino acid sequence having at least 95% identity to an amino acid sequence of SEQ ID NO:2514. In one aspect, provided herein is an antibody that binds TRDV2, comprising a VH having an amino acid sequence having at least 95% identity to an amino acid sequence of SEQ ID NO:2513, and a VL having an amino acid sequence having at least 95% identity to an amino acid sequence of SEQ ID NO:2514. In one aspect, provided herein is an antibody that binds TRDV2, comprising a heavy chain having an amino acid sequence having at least 95% identity to an amino acid sequence of SEQ ID NO:2515. In one aspect, provided herein is an antibody that binds TRDV2, comprising a light chain having an amino acid sequence having at least 95% identity to an amino acid sequence of SEQ ID NO:2516. In one aspect, provided herein is an antibody that binds TRDV2, comprising a heavy chain having an amino acid sequence having at least 95% identity to an amino acid sequence of SEQ ID NO:2515, and a light chain having an amino acid sequence having at least 95% identity to an amino acid sequence of SEQ ID NO:2516.

In one aspect, provided herein is an antibody that binds TRDV2, comprising: (i) a VH comprising a VH CDR1, a VH CDR2, and a VH CDR3 having an amino acid sequence of SEQ ID NOs:2517, 2518, and 2519, respectively, and (ii)

a VL comprising a VL CDR1, VL CDR2, and VL CDR3 having an amino acid sequence of SEQ ID NOs:2520, 2521, and 2522, respectively. In one aspect, provided herein is an antibody that binds TRDV2, comprising: (i) a VH comprising a VH CDR1, a VH CDR2, and a VH CDR3 having an amino acid sequence of SEQ ID NOs:2523, 2524, and 2525, respectively, and (ii) a VL comprising a VL CDR1, VL CDR2, and VL CDR3 having an amino acid sequence of SEQ ID NOs:2526, 2527, and 2528, respectively. In one aspect, provided herein is an antibody that binds TRDV2, comprising: (i) a VH comprising a VH CDR1, a VH CDR2, and a VH CDR3 having an amino acid sequence of SEQ ID NOs:2529, 2530, and 2531, respectively, and (ii) a VL comprising a VL CDR1, VL CDR2, and VL CDR3 having an amino acid sequence of SEQ ID NOs:2532, 2533, and 2534, respectively. In one aspect, provided herein is an antibody that binds TRDV2, comprising: (i) a VH comprising a VH CDR1, a VH CDR2, and a VH CDR3 having an amino acid sequence of SEQ ID NOs:2535, 2536, and 2537, respectively, and (ii) a VL comprising a VL CDR1, VL CDR2, and VL CDR3 having an amino acid sequence of SEQ ID NOs:2538, 2539, and 2540, respectively. In one aspect, provided herein is an antibody that binds TRDV2, comprising: (i) a VH comprising a VH CDR1, a VH CDR2, and a VH CDR3 having an amino acid sequence of SEQ ID NOs:2541, 2542, and 2543, respectively, and (ii) a VL comprising a VL CDR1, VL CDR2, and VL CDR3 having an amino acid sequence of SEQ ID NOs:2544, 2545, and 2546, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2547; and (ii) a VL comprising a VL CDR1, a VL CDR2, and a VL CDR3 having an amino acid sequence of a VL CDR1, a VL CDR2, and a VL CDR3, respectively, of SEQ ID NO:2548. In one aspect, provided herein is an antibody that binds TRDV2, comprising a VH having an amino acid sequence of SEQ ID NO:2547. In one aspect, provided herein is an antibody that binds TRDV2, comprising a VL having an amino acid sequence of SEQ ID NO:2548. In one aspect, provided herein is an antibody that binds TRDV2, comprising a VH having an amino acid sequence of SEQ ID NO:2547, and a VL having an amino acid sequence of SEQ ID NO:2548. In one aspect, provided herein is an antibody that binds TRDV2, comprising a heavy chain having an amino acid sequence of SEQ ID NO:2549. In one aspect, provided herein is an antibody that binds TRDV2, comprising a light chain having an amino acid sequence of SEQ ID NO:2550. In one aspect, provided herein is an antibody that binds TRDV2, comprising a heavy chain having an amino acid sequence of SEQ ID NO:2549, and a light chain having an amino acid sequence of SEQ ID NO:2550. In one aspect, provided herein is an antibody that binds TRDV2, comprising a VH having an amino acid sequence having at least 95% identity to an amino acid sequence of SEQ ID NO:2547. In one aspect, provided herein is an antibody that binds TRDV2, comprising a VL having an amino acid sequence having at least 95% identity to an amino acid sequence of SEQ ID NO:2548. In one aspect, provided herein is an antibody that binds TRDV2, comprising a VH having an amino acid sequence having at least 95% identity to an amino acid sequence of SEQ ID NO:2547, and a VL having an amino acid sequence having at least 95% identity to an amino acid sequence of SEQ ID NO:2548. In one aspect, provided herein is an antibody that binds TRDV2, comprising a heavy chain having an amino acid sequence having at least 95% identity to an amino acid sequence of SEQ ID NO:2549. In one aspect, provided herein is an antibody that binds TRDV2, comprising a light chain having an amino acid sequence having at least 95% identity to an amino acid sequence of SEQ ID NO:2550. In one aspect, provided herein is an antibody that binds TRDV2, comprising a heavy chain having an amino acid sequence having at least 95% identity to an amino acid sequence of SEQ ID NO:2549, and a light chain having an amino acid sequence having at least 95% identity to an amino acid sequence of SEQ ID NO:2550.

In one aspect, provided herein is an antibody that binds TRDV2, comprising: (i) a VH comprising a VH CDR1, a VH CDR2, and a VH CDR3 having an amino acid sequence of SEQ ID NOs:2551, 2552, and 2553, respectively, and (ii) a VL comprising a VL CDR1, VL CDR2, and VL CDR3 having an amino acid sequence of SEQ ID NOs:2554, 2555, and 2556, respectively. In one aspect, provided herein is an antibody that binds TRDV2, comprising: (i) a VH comprising a VH CDR1, a VH CDR2, and a VH CDR3 having an amino acid sequence of SEQ ID NOs:2557, 2558, and 2559, respectively, and (ii) a VL comprising a VL CDR1, VL CDR2, and VL CDR3 having an amino acid sequence of SEQ ID NOs:2560, 2561, and 2562, respectively. In one aspect, provided herein is an antibody that binds TRDV2, comprising: (i) a VH comprising a VH CDR1, a VH CDR2, and a VH CDR3 having an amino acid sequence of SEQ ID NOs:2563, 2564, and 2565, respectively, and (ii) a VL comprising a VL CDR1, VL CDR2, and VL CDR3 having an amino acid sequence of SEQ ID NOs:2566, 2567, and 2568, respectively. In one aspect, provided herein is an antibody that binds TRDV2, comprising: (i) a VH comprising a VH CDR1, a VH CDR2, and a VH CDR3 having an amino acid sequence of SEQ ID NOs:2569, 2570, and 2571, respectively, and (ii) a VL comprising a VL CDR1, VL CDR2, and VL CDR3 having an amino acid sequence of SEQ ID NOs:2572, 2573, and 2574, respectively. In one aspect, provided herein is an antibody that binds TRDV2, comprising: (i) a VH comprising a VH CDR1, a VH CDR2, and a VH CDR3 having an amino acid sequence of SEQ ID NOs:2575, 2576, and 2577, respectively, and (ii) a VL comprising a VL CDR1, VL CDR2, and VL CDR3 having an amino acid sequence of SEQ ID NOs:2578, 2579, and 2580, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2581; and (ii) a VL comprising a VL CDR1, a VL CDR2, and a VL CDR3 having an amino acid sequence of a VL CDR1, a VL CDR2, and a VL CDR3, respectively, of SEQ ID NO:2582. In one aspect, provided herein is an antibody that binds TRDV2, comprising a VH having an amino acid sequence of SEQ ID NO:2581. In one aspect, provided herein is an antibody that binds TRDV2, comprising a VL having an amino acid sequence of SEQ ID NO:2582. In one aspect, provided herein is an antibody that binds TRDV2, comprising a VH having an amino acid sequence of SEQ ID NO:2581, and a VL having an amino acid sequence of SEQ ID NO:2582. In one aspect, provided herein is an antibody that binds TRDV2, comprising a heavy chain having an amino acid sequence of SEQ ID NO:2583. In one aspect, provided herein is an antibody that binds TRDV2, comprising a light chain having an amino acid sequence of SEQ ID NO:2584. In one aspect, provided herein is an antibody that binds TRDV2, comprising a heavy chain having an amino acid sequence of SEQ ID NO:2583, and a light chain having an amino acid sequence of SEQ ID NO:2584. In one aspect, provided herein is an antibody that binds TRDV2, comprising a VH having an amino acid sequence having at least 95% identity to an amino acid sequence of SEQ ID NO:2581. In one aspect, provided herein is an antibody that binds TRDV2, comprising a VL having an amino acid sequence having at least 95% identity to an amino acid sequence of SEQ ID NO:2582. In one aspect, provided herein is an antibody that binds TRDV2, comprising a VH having an amino acid sequence having at least 95% identity to an amino acid sequence of SEQ ID NO:2581, and a VL having an amino acid sequence having at least 95% identity to an amino acid sequence of SEQ ID NO:2582. In one aspect, provided herein is an antibody that binds TRDV2, comprising a heavy chain having an amino acid sequence having at least 95% identity to an amino acid sequence of SEQ ID NO:2583. In one aspect, provided herein is an antibody that binds TRDV2, comprising a light chain having an amino acid sequence having at least 95% identity to an amino acid sequence of SEQ ID NO:2584. In one aspect, provided herein is an antibody that binds TRDV2, comprising a heavy chain having an amino acid sequence having at least 95% identity to an amino acid sequence of SEQ ID NO:2583, and a light chain having an amino acid sequence having at least 95% identity to an amino acid sequence of SEQ ID NO:2584.

In one aspect, provided herein is an antibody that binds TRDV2, comprising: (i) a VH comprising a VH CDR1, a VH CDR2, and a VH CDR3 having an amino acid sequence of SEQ ID NOs:2585, 2586, and 2587, respectively, and (ii) a VL comprising a VL CDR1, VL CDR2, and VL CDR3 having an amino acid sequence of SEQ ID NOs:2588, 2589, and 2590, respectively. In one aspect, provided herein is an antibody that binds TRDV2, comprising: (i) a VH comprising a VH CDR1, a VH CDR2, and a VH CDR3 having an amino acid sequence of SEQ ID NOs:2591, 2592, and 2593, respectively, and (ii) a VL comprising a VL CDR1, VL CDR2, and VL CDR3 having an amino acid sequence of SEQ ID NOs:2594, 2595, and 2596, respectively. In one aspect, provided herein is an antibody that binds TRDV2, comprising: (i) a VH comprising a VH CDR1, a VH CDR2, and a VH CDR3 having an amino acid sequence of SEQ ID NOs:2597, 2598, and 2599, respectively, and (ii) a VL comprising a VL CDR1, VL CDR2, and VL CDR3 having an amino acid sequence of SEQ ID NOs:2600, 2601, and 2602, respectively. In one aspect, provided herein is an antibody that binds TRDV2, comprising: (i) a VH comprising a VH CDR1, a VH CDR2, and a VH CDR3 having an amino acid sequence of SEQ ID NOs:2603, 2604, and 2605, respectively, and (ii) a VL comprising a VL CDR1, VL CDR2, and VL CDR3 having an amino acid sequence of SEQ ID NOs:2606, 2607, and 2608, respectively. In one aspect, provided herein is an antibody that binds TRDV2, comprising: (i) a VH comprising a VH CDR1, a VH CDR2, and a VH CDR3 having an amino acid sequence of SEQ ID NOs:2609, 2610, and 2611, respectively, and (ii) a VL comprising a VL CDR1, VL CDR2, and VL CDR3 having an amino acid sequence of SEQ ID NOs:2612, 2613, and 2614, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2615; and (ii) a VL comprising a VL CDR1, a VL CDR2, and a VL CDR3 having an amino acid sequence of a VL CDR1, a VL CDR2, and a VL CDR3, respectively, of SEQ ID NO:2616. In one aspect, provided herein is an antibody that binds TRDV2, comprising a VH having an amino acid sequence of SEQ ID NO:2615. In one aspect, provided herein is an antibody that binds TRDV2, comprising a VL having an amino acid sequence of SEQ ID NO:2616. In one aspect, provided herein is an antibody that binds TRDV2, comprising a VH having an amino acid sequence of SEQ ID NO:2615, and a VL having an amino acid sequence of SEQ ID NO:2616. In one aspect, provided herein is an antibody that binds TRDV2, comprising a heavy chain having an amino acid sequence of SEQ ID NO:2617. In one aspect, provided herein is an antibody that binds TRDV2, comprising a light chain having an amino acid sequence of SEQ ID NO:2618. In one aspect, provided herein is an antibody that binds TRDV2, comprising a heavy chain having an amino acid sequence of SEQ ID NO:2617, and a light chain having an amino acid sequence of SEQ ID NO:2618. In one aspect, provided herein is an antibody that binds TRDV2, comprising a VH having an amino acid sequence having at least 95% identity to an amino acid sequence of SEQ ID NO:2615. In one aspect, provided herein is an antibody that binds TRDV2, comprising a VL having an amino acid sequence having at least 95% identity to an amino acid sequence of SEQ ID NO:2616. In one aspect, provided herein is an antibody that binds TRDV2, comprising a VH having an amino acid sequence having at least 95% identity to an amino acid sequence of SEQ ID NO:2615, and a VL having an amino acid sequence having at least 95% identity to an amino acid sequence of SEQ ID NO:2616. In one aspect, provided herein is an antibody that binds TRDV2, comprising a heavy chain having an amino acid sequence having at least 95% identity to an amino acid sequence of SEQ ID NO:2617. In one aspect, provided herein is an antibody that binds TRDV2, comprising a light chain having an amino acid sequence having at least 95% identity to an amino acid sequence of SEQ ID NO:2618. In one aspect, provided herein is an antibody that binds TRDV2, comprising a heavy chain having an amino acid sequence having at least 95% identity to an amino acid sequence of SEQ ID NO:2617, and a light chain having an amino acid sequence having at least 95% identity to an amino acid sequence of SEQ ID NO:2618.

In one aspect, provided herein is an antibody that binds TRDV2, comprising: (i) a VH comprising a VH CDR1, a VH CDR2, and a VH CDR3 having an amino acid sequence of SEQ ID NOs:2619, 2620, and 2621, respectively, and (ii) a VL comprising a VL CDR1, VL CDR2, and VL CDR3 having an amino acid sequence of SEQ ID NOs:2622, 2623, and 2624, respectively. In one aspect, provided herein is an antibody that binds TRDV2, comprising: (i) a VH comprising a VH CDR1, a VH CDR2, and a VH CDR3 having an amino acid sequence of SEQ ID NOs:2625, 2626, and 2627, respectively, and (ii) a VL comprising a VL CDR1, VL CDR2, and VL CDR3 having an amino acid sequence of SEQ ID NOs:2628, 2629, and 2630, respectively. In one aspect, provided herein is an antibody that binds TRDV2, comprising: (i) a VH comprising a VH CDR1, a VH CDR2, and a VH CDR3 having an amino acid sequence of SEQ ID NOs:2631, 2632, and 2633, respectively, and (ii) a VL comprising a VL CDR1, VL CDR2, and VL CDR3 having an amino acid sequence of SEQ ID NOs:2634, 2635, and 2636, respectively. In one aspect, provided herein is an antibody that binds TRDV2, comprising: (i) a VH comprising a VH CDR1, a VH CDR2, and a VH CDR3 having an amino acid sequence of SEQ ID NOs:2637, 2638, and 2639, respectively, and (ii) a VL comprising a VL CDR1, VL CDR2, and VL CDR3 having an amino acid sequence of SEQ ID NOs:2640, 2641, and 2642, respectively. In one aspect, provided herein is an antibody that binds TRDV2, comprising: (i) a VH comprising a VH CDR1, a VH CDR2, and a VH CDR3 having an amino acid sequence of SEQ ID NOs:2643, 2644, and 2645, respectively, and (ii) a VL comprising a VL CDR1, VL CDR2, and VL CDR3 having an amino acid sequence of SEQ ID NOs:2646, 2647, and 2648, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2649; and (ii) a VL comprising a VL CDR1, a VL CDR2, and a VL CDR3 having an amino acid sequence of a VL CDR1, a VL CDR2, and a VL CDR3, respectively, of SEQ ID NO:2650. In one aspect, provided herein is an antibody that binds TRDV2, comprising a VH having an amino acid sequence of SEQ ID NO:2649. In one aspect, provided herein is an antibody that binds TRDV2, comprising a VL having an amino acid sequence of SEQ ID NO:2650. In one aspect, provided herein is an antibody that binds TRDV2, comprising a VH having an amino acid sequence of SEQ ID NO:2649, and a VL having an amino acid sequence of SEQ ID NO:2650. In one aspect, provided herein is an antibody that binds TRDV2, comprising a heavy chain having an amino acid sequence of SEQ ID NO:2651. In one aspect, provided herein is an antibody that binds TRDV2, comprising a light chain having an amino acid sequence of SEQ ID NO:2652. In one aspect, provided herein is an antibody that binds TRDV2, comprising a heavy chain having an amino acid sequence of SEQ ID NO:2651, and a light chain having an amino acid sequence of SEQ ID NO:2652. In one aspect, provided herein is an antibody that binds TRDV2, comprising a VH having an amino acid sequence having at least 95% identity to an amino acid sequence of SEQ ID NO:2649. In one aspect, provided herein is an antibody that binds TRDV2, comprising a VL having an amino acid sequence having at least 95% identity to an amino acid sequence of SEQ ID NO:2650. In one aspect, provided herein is an antibody that binds TRDV2, comprising a VH having an amino acid sequence having at least 95% identity to an amino acid sequence of SEQ ID NO:2649, and a VL having an amino acid sequence having at least 95% identity to an amino acid sequence of SEQ ID NO:2650. In one aspect, provided herein is an antibody that binds TRDV2, comprising a heavy chain having an amino acid sequence having at least 95% identity to an amino acid sequence of SEQ ID NO:2651. In one aspect, provided herein is an antibody that binds TRDV2, comprising a light chain having an amino acid sequence having at least 95% identity to an amino acid sequence of SEQ ID NO:2652. In one aspect, provided herein is an antibody that binds TRDV2, comprising a heavy chain having an amino acid sequence having at least 95% identity to an amino acid sequence of SEQ ID NO:2651, and a light chain having an amino acid sequence having at least 95% identity to an amino acid sequence of SEQ ID NO:2652.

In one aspect, provided herein is an antibody that binds TRDV2, comprising: (i) a VH comprising a VH CDR1, a VH CDR2, and a VH CDR3 having an amino acid sequence of SEQ ID NOs:2653, 2654, and 2655, respectively, and (ii) a VL comprising a VL CDR1, VL CDR2, and VL CDR3 having an amino acid sequence of SEQ ID NOs:2656, 2657, and 2658, respectively. In one aspect, provided herein is an antibody that binds TRDV2, comprising: (i) a VH comprising a VH CDR1, a VH CDR2, and a VH CDR3 having an amino acid sequence of SEQ ID NOs:2659, 2660, and 2661, respectively, and (ii) a VL comprising a VL CDR1, VL CDR2, and VL CDR3 having an amino acid sequence of SEQ ID NOs:2662, 2663, and 2664, respectively. In one aspect, provided herein is an antibody that binds TRDV2, comprising: (i) a VH comprising a VH CDR1, a VH CDR2, and a VH CDR3 having an amino acid sequence of SEQ ID NOs:2665, 2666, and 2667, respectively, and (ii) a VL comprising a VL CDR1, VL CDR2, and VL CDR3 having an amino acid sequence of SEQ ID NOs:2668, 2669, and 2670, respectively. In one aspect, provided herein is an antibody that binds TRDV2, comprising: (i) a VH comprising a VH CDR1, a VH CDR2, and a VH CDR3 having an amino acid sequence of SEQ ID NOs:2671, 2672, and 2673, respectively, and (ii) a VL comprising a VL CDR1, VL CDR2, and VL CDR3 having an amino acid sequence of SEQ ID NOs:2674, 2675, and 2676, respectively. In one aspect, provided herein is an antibody that binds TRDV2, comprising: (i) a VH comprising a VH CDR1, a VH CDR2, and a VH CDR3 having an amino acid sequence of SEQ ID NOs:2677, 2678, and 2679, respectively, and (ii) a VL comprising a VL CDR1, VL CDR2, and VL CDR3 having an amino acid sequence of SEQ ID NOs:2680, 2681, and 2682, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2683; and (ii) a VL comprising a VL CDR1, a VL CDR2, and a VL CDR3 having an amino acid sequence of a VL CDR1, a VL CDR2, and a VL CDR3, respectively, of SEQ ID NO:2684. In one aspect, provided herein is an antibody that binds TRDV2, comprising a VH having an amino acid sequence of SEQ ID NO:2683. In one aspect, provided herein is an antibody that binds TRDV2, comprising a VL having an amino acid sequence of SEQ ID NO:2684. In one aspect, provided herein is an antibody that binds TRDV2, comprising a VH having an amino acid sequence of SEQ ID NO:2683, and a VL having an amino acid sequence of SEQ ID NO:2684. In one aspect, provided herein is an antibody that binds TRDV2, comprising a heavy chain having an amino acid sequence of SEQ ID NO:2685. In one aspect, provided herein is an antibody that binds TRDV2, comprising a light chain having an amino acid sequence of SEQ ID NO:2686. In one aspect, provided herein is an antibody that binds TRDV2, comprising a heavy chain having an amino acid sequence of SEQ ID NO:2685, and a light chain having an amino acid sequence of SEQ ID NO:2686. In one aspect, provided herein is an antibody that binds TRDV2, comprising a VH having an amino acid sequence having at least 95% identity to an amino acid sequence of SEQ ID NO:2683. In one aspect, provided herein is an antibody that binds TRDV2, comprising a VL having an amino acid sequence having at least 95% identity to an amino acid sequence of SEQ ID NO:2684. In one aspect, provided herein is an antibody that binds TRDV2, comprising a VH having an amino acid sequence having at least 95% identity to an amino acid sequence of SEQ ID NO:2683, and a VL having an amino acid sequence having at least 95% identity to an amino acid sequence of SEQ ID NO:2684. In one aspect, provided herein is an antibody that binds TRDV2, comprising a heavy chain having an amino acid sequence having at least 95% identity to an amino acid sequence of SEQ ID NO:2685. In one aspect, provided herein is an antibody that binds TRDV2, comprising a light chain having an amino acid sequence having at least 95% identity to an amino acid sequence of SEQ ID NO:2686. In one aspect, provided herein is an antibody that binds TRDV2, comprising a heavy chain having an amino acid sequence having at least 95% identity to an amino acid sequence of SEQ ID NO:2685, and a light chain having an amino acid sequence having at least 95% identity to an amino acid sequence of SEQ ID NO:266.

In one aspect, provided herein is an antibody that binds TRDV2, comprising: (i) a VH comprising a VH CDR1, a VH CDR2, and a VH CDR3 having an amino acid sequence of SEQ ID NOs:2687, 2688, and 2689, respectively, and (ii) a VL comprising a VL CDR1, VL CDR2, and VL CDR3 having an amino acid sequence of SEQ ID NOs:2690, 2691, and 2692, respectively. In one aspect, provided herein is an antibody that binds TRDV2, comprising: (i) a VH comprising a VH CDR1, a VH CDR2, and a VH CDR3 having an amino acid sequence of SEQ ID NOs:2693, 2694, and 2695, respectively, and (ii) a VL comprising a VL CDR1, VL CDR2, and VL CDR3 having an amino acid sequence of SEQ ID NOs:2696, 2697, and 2698, respectively. In one aspect, provided herein is an antibody that binds TRDV2, comprising: (i) a VH comprising a VH CDR1, a VH CDR2, and a VH CDR3 having an amino acid sequence of SEQ ID NOs:2699, 2700, and 2701, respectively, and (ii) a VL comprising a VL CDR1, VL CDR2, and VL CDR3 having an amino acid sequence of SEQ ID NOs:2702, 2703, and 2704, respectively. In one aspect, provided herein is an antibody that binds TRDV2, comprising: (i) a VH comprising a VH CDR1, a VH CDR2, and a VH CDR3 having an amino acid sequence of SEQ ID NOs:2705, 2706, and 2707, respectively, and (ii) a VL comprising a VL CDR1, VL CDR2, and VL CDR3 having an amino acid sequence of SEQ ID NOs:2708, 2709, and 2710, respectively. In one aspect, provided herein is an antibody that binds TRDV2, comprising: (i) a VH comprising a VH CDR1, a VH CDR2, and a VH CDR3 having an amino acid sequence of SEQ ID NOs:2711, 2712, and 2713, respectively, and (ii) a VL comprising a VL CDR1, VL CDR2, and VL CDR3 having an amino acid sequence of SEQ ID NOs:2714, 2715, and 2716, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2717; and (ii) a VL comprising a VL CDR1, a VL CDR2, and a VL CDR3 having an amino acid sequence of a VL CDR1, a VL CDR2, and a VL CDR3, respectively, of SEQ ID NO:2718. In one aspect, provided herein is an antibody that binds TRDV2, comprising a VH having an amino acid sequence of SEQ ID NO:2717. In one aspect, provided herein is an antibody that binds TRDV2, comprising a VL having an amino acid sequence of SEQ ID NO:2718. In one aspect, provided herein is an antibody that binds TRDV2, comprising a VH having an amino acid sequence of SEQ ID NO:2717, and a VL having an amino acid sequence of SEQ ID NO:2718. In one aspect, provided herein is an antibody that binds TRDV2, comprising a heavy chain having an amino acid sequence of SEQ ID NO:2719. In one aspect, provided herein is an antibody that binds TRDV2, comprising a light chain having an amino acid sequence of SEQ ID NO:2720. In one aspect, provided herein is an antibody that binds TRDV2, comprising a heavy chain having an amino acid sequence of SEQ ID NO:2719, and a light chain having an amino acid sequence of SEQ ID NO:2720. In one aspect, provided herein is an antibody that binds TRDV2, comprising a VH having an amino acid sequence having at least 95% identity to an amino acid sequence of SEQ ID NO:2717. In one aspect, provided herein is an antibody that binds TRDV2, comprising a VL having an amino acid sequence having at least 95% identity to an amino acid sequence of SEQ ID NO:2718. In one aspect, provided herein is an antibody that binds TRDV2, comprising a VH having an amino acid sequence having at least 95% identity to an amino acid sequence of SEQ ID NO:2717, and a VL having an amino acid sequence having at least 95% identity to an amino acid sequence of SEQ ID NO:2718. In one aspect, provided herein is an antibody that binds TRDV2, comprising a heavy chain having an amino acid sequence having at least 95% identity to an amino acid sequence of SEQ ID NO:2719. In one aspect, provided herein is an antibody that binds TRDV2, comprising a light chain having an amino acid sequence having at least 95% identity to an amino acid sequence of SEQ ID NO:2720. In one aspect, provided herein is an antibody that binds TRDV2, comprising a heavy chain having an amino acid sequence having at least 95% identity to an amino acid sequence of SEQ ID NO:2719, and a light chain having an amino acid sequence having at least 95% identity to an amino acid sequence of SEQ ID NO:2720.

In one aspect, provided herein is an antibody that binds TRDV2, comprising: (i) a VH comprising a VH CDR1, a VH CDR2, and a VH CDR3 having an amino acid sequence of SEQ ID NOs:2721, 2722, and 2723, respectively, and (ii) a VL comprising a VL CDR1, VL CDR2, and VL CDR3 having an amino acid sequence of SEQ ID NOs:2724, 2725, and 2726, respectively. In one aspect, provided herein is an antibody that binds TRDV2, comprising: (i) a VH comprising a VH CDR1, a VH CDR2, and a VH CDR3 having an amino acid sequence of SEQ ID NOs:2727, 2728, and 2729, respectively, and (ii) a VL comprising a VL CDR1, VL CDR2, and VL CDR3 having an amino acid sequence of SEQ ID NOs:2730, 2731, and 2732, respectively. In one aspect, provided herein is an antibody that binds TRDV2, comprising: (i) a VH comprising a VH CDR1, a VH CDR2, and a VH CDR3 having an amino acid sequence of SEQ ID NOs:2733, 2734, and 2735, respectively, and (ii) a VL comprising a VL CDR1, VL CDR2, and VL CDR3 having an amino acid sequence of SEQ ID NOs:2736, 2737, and 2738, respectively. In one aspect, provided herein is an antibody that binds TRDV2, comprising: (i) a VH comprising a VH CDR1, a VH CDR2, and a VH CDR3 having an amino acid sequence of SEQ ID NOs:2739, 2740, and 2741, respectively, and (ii) a VL comprising a VL CDR1, VL CDR2, and VL CDR3 having an amino acid sequence of SEQ ID NOs:2742, 2743, and 2744, respectively. In one aspect, provided herein is an antibody that binds TRDV2, comprising: (i) a VH comprising a VH CDR1, a VH CDR2, and a VH CDR3 having an amino acid sequence of SEQ ID NOs:2745, 2746, and 2747, respectively, and (ii) a VL comprising a VL CDR1, VL CDR2, and VL CDR3 having an amino acid sequence of SEQ ID NOs:2748, 2749, and 2750, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2751; and (ii) a VL comprising a VL CDR1, a VL CDR2, and a VL CDR3 having an amino acid sequence of a VL CDR1, a VL CDR2, and a VL CDR3, respectively, of SEQ ID NO:2752. In one aspect, provided herein is an antibody that binds TRDV2, comprising a VH having an amino acid sequence of SEQ ID NO:2751. In one aspect, provided herein is an antibody that binds TRDV2, comprising a VL having an amino acid sequence of SEQ ID NO:2752. In one aspect, provided herein is an antibody that binds TRDV2, comprising a VH having an amino acid sequence of SEQ ID NO:2751, and a VL having an amino acid sequence of SEQ ID NO:2752. In one aspect, provided herein is an antibody that binds TRDV2, comprising a heavy chain having an amino acid sequence of SEQ ID NO:2753. In one aspect, provided herein is an antibody that binds TRDV2, comprising a light chain having an amino acid sequence of SEQ ID NO:2754. In one aspect, provided herein is an antibody that binds TRDV2, comprising a heavy chain having an amino acid sequence of SEQ ID NO:2753, and a light chain having an amino acid sequence of SEQ ID NO:2754. In one aspect, provided herein is an antibody that binds TRDV2, comprising a VH having an amino acid sequence having at least 95% identity to an amino acid sequence of SEQ ID NO:2751. In one aspect, provided herein is an antibody that binds TRDV2, comprising a VL having an amino acid sequence having at least 95% identity to an amino acid sequence of SEQ ID NO:2752. In one aspect, provided herein is an antibody that binds TRDV2, comprising a VH having an amino acid sequence having at least 95% identity to an amino acid sequence of SEQ ID NO:2751, and a VL having an amino acid sequence having at least 95% identity to an amino acid sequence of SEQ ID NO:2752. In one aspect, provided herein is an antibody that binds TRDV2, comprising a heavy chain having an amino acid sequence having at least 95% identity to an amino acid sequence of SEQ ID NO:2753. In one aspect, provided herein is an antibody that binds TRDV2, comprising a light chain having an amino acid sequence having at least 95% identity to an amino acid sequence of SEQ ID NO:2754. In one aspect, provided herein is an antibody that binds TRDV2, comprising a heavy chain having an amino acid sequence having at least 95% identity to an amino acid sequence of SEQ ID NO:2753, and a light chain having an amino acid sequence having at least 95% identity to an amino acid sequence of SEQ ID NO:2754.

In one aspect, provided herein is an antibody that binds TRDV2, comprising: (i) a VH comprising a VH CDR1, a VH CDR2, and a VH CDR3 having an amino acid sequence of SEQ ID NOs:2755, 2756, and 2757, respectively, and (ii) a VL comprising a VL CDR1, VL CDR2, and VL CDR3 having an amino acid sequence of SEQ ID NOs:2758, 2759, and 2760, respectively. In one aspect, provided herein is an antibody that binds TRDV2, comprising: (i) a VH comprising a VH CDR1, a VH CDR2, and a VH CDR3 having an amino acid sequence of SEQ ID NOs:2761, 2762, and 2763, respectively, and (ii) a VL comprising a VL CDR1, VL CDR2, and VL CDR3 having an amino acid sequence of SEQ ID NOs:2764, 2765, and 2766, respectively. In one aspect, provided herein is an antibody that binds TRDV2, comprising: (i) a VH comprising a VH CDR1, a VH CDR2, and a VH CDR3 having an amino acid sequence of SEQ ID NOs:2767, 2768, and 2769, respectively, and (ii) a VL comprising a VL CDR1, VL CDR2, and VL CDR3 having an amino acid sequence of SEQ ID NOs:2770, 2771, and 2772, respectively. In one aspect, provided herein is an antibody that binds TRDV2, comprising: (i) a VH comprising a VH CDR1, a VH CDR2, and a VH CDR3 having an amino acid sequence of SEQ ID NOs:2773, 2774, and 2775, respectively, and (ii) a VL comprising a VL CDR1, VL CDR2, and VL CDR3 having an amino acid sequence of SEQ ID NOs:2776, 2777, and 2778, respectively. In one aspect, provided herein is an antibody that binds TRDV2, comprising: (i) a VH comprising a VH CDR1, a VH CDR2, and a VH CDR3 having an amino acid sequence of SEQ ID NOs:2779, 2780, and 2781, respectively, and (ii) a VL comprising a VL CDR1, VL CDR2, and VL CDR3 having an amino acid sequence of SEQ ID NOs:2782, 2783, and 2784, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2785; and (ii) a VL comprising a VL CDR1, a VL CDR2, and a VL CDR3 having an amino acid sequence of a VL CDR1, a VL CDR2, and a VL CDR3, respectively, of SEQ ID NO:2786. In one aspect, provided herein is an antibody that binds TRDV2, comprising a VH having an amino acid sequence of SEQ ID NO:2785. In one aspect, provided herein is an antibody that binds TRDV2, comprising a VL having an amino acid sequence of SEQ ID NO:2786. In one aspect, provided herein is an antibody that binds TRDV2, comprising a VH having an amino acid sequence of SEQ ID NO:2785, and a VL having an amino acid sequence of SEQ ID NO:2786. In one aspect, provided herein is an antibody that binds TRDV2, comprising a heavy chain having an amino acid sequence of SEQ ID NO:2787. In one aspect, provided herein is an antibody that binds TRDV2, comprising a light chain having an amino acid sequence of SEQ ID NO:2788. In one aspect, provided herein is an antibody that binds TRDV2, comprising a heavy chain having an amino acid sequence of SEQ ID NO:2787, and a light chain having an amino acid sequence of SEQ ID NO:2788. In one aspect, provided herein is an antibody that binds TRDV2, comprising a VH having an amino acid sequence having at least 95% identity to an amino acid sequence of SEQ ID NO:2785. In one aspect, provided herein is an antibody that binds TRDV2, comprising a VL having an amino acid sequence having at least 95% identity to an amino acid sequence of SEQ ID NO:2786. In one aspect, provided herein is an antibody that binds TRDV2, comprising a VH having an amino acid sequence having at least 95% identity to an amino acid sequence of SEQ ID NO:2785, and a VL having an amino acid sequence having at least 95% identity to an amino acid sequence of SEQ ID NO:2786. In one aspect, provided herein is an antibody that binds TRDV2, comprising a heavy chain having an amino acid sequence having at least 95% identity to an amino acid sequence of SEQ ID NO:2787. In one aspect, provided herein is an antibody that binds TRDV2, comprising a light chain having an amino acid sequence having at least 95% identity to an amino acid sequence of SEQ ID NO:2788. In one aspect, provided herein is an antibody that binds TRDV2, comprising a heavy chain having an amino acid sequence having at least 95% identity to an amino acid sequence of SEQ ID NO:2787, and a light chain having an amino acid sequence having at least 95% identity to an amino acid sequence of SEQ ID NO:2788.

In one aspect, provided herein is an antibody that binds TRDV2, comprising: (i) a VH comprising a VH CDR1, a VH CDR2, and a VH CDR3 having an amino acid sequence of SEQ ID NOs:2789, 2790, and 2791, respectively, and (ii) a VL comprising a VL CDR1, VL CDR2, and VL CDR3 having an amino acid sequence of SEQ ID NOs:2792, 2793, and 2794, respectively. In one aspect, provided herein is an antibody that binds TRDV2, comprising: (i) a VH comprising a VH CDR1, a VH CDR2, and a VH CDR3 having an amino acid sequence of SEQ ID NOs:2795, 2796, and 2797, respectively, and (ii) a VL comprising a VL CDR1, VL CDR2, and VL CDR3 having an amino acid sequence of SEQ ID NOs:2798, 2799, and 2800, respectively. In one aspect, provided herein is an antibody that binds TRDV2, comprising: (i) a VH comprising a VH CDR1, a VH CDR2, and a VH CDR3 having an amino acid sequence of SEQ ID NOs:2801, 2802, and 2803, respectively, and (ii) a VL comprising a VL CDR1, VL CDR2, and VL CDR3 having an amino acid sequence of SEQ ID NOs:2804, 2805, and 2806, respectively. In one aspect, provided herein is an antibody that binds TRDV2, comprising: (i) a VH comprising a VH CDR1, a VH CDR2, and a VH CDR3 having an amino acid sequence of SEQ ID NOs:2807, 2808, and 2809, respectively, and (ii) a VL comprising a VL CDR1, VL CDR2, and VL CDR3 having an amino acid sequence of SEQ ID NOs:2810, 2811, and 2812, respectively. In one aspect, provided herein is an antibody that binds TRDV2, comprising: (i) a VH comprising a VH CDR1, a VH CDR2, and a VH CDR3 having an amino acid sequence of SEQ ID NOs:2813, 2814, and 2815, respectively, and (ii) a VL comprising a VL CDR1, VL CDR2, and VL CDR3 having an amino acid sequence of SEQ ID NOs:2816, 2817, and 2818, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2819; and (ii) a VL comprising a VL CDR1, a VL CDR2, and a VL CDR3 having an amino acid sequence of a VL CDR1, a VL CDR2, and a VL CDR3, respectively, of SEQ ID NO:2820. In one aspect, provided herein is an antibody that binds TRDV2, comprising a VH having an amino acid sequence of SEQ ID NO:2819. In one aspect, provided herein is an antibody that binds TRDV2, comprising a VL having an amino acid sequence of SEQ ID NO:2820. In one aspect, provided herein is an antibody that binds TRDV2, comprising a VH having an amino acid sequence of SEQ ID NO:2819, and a VL having an amino acid sequence of SEQ ID NO:2820. In one aspect, provided herein is an antibody that binds TRDV2, comprising a heavy chain having an amino acid sequence of SEQ ID NO:2821. In one aspect, provided herein is an antibody that binds TRDV2, comprising a light chain having an amino acid sequence of SEQ ID NO:2822. In one aspect, provided herein is an antibody that binds TRDV2, comprising a heavy chain having an amino acid sequence of SEQ ID NO:2821, and a light chain having an amino acid sequence of SEQ ID NO:2822. In one aspect, provided herein is an antibody that binds TRDV2, comprising a VH having an amino acid sequence having at least 95% identity to an amino acid sequence of SEQ ID NO:2819. In one aspect, provided herein is an antibody that binds TRDV2, comprising a VL having an amino acid sequence having at least 95% identity to an amino acid sequence of SEQ ID NO:2820. In one aspect, provided herein is an antibody that binds TRDV2, comprising a VH having an amino acid sequence having at least 95% identity to an amino acid sequence of SEQ ID NO:2819, and a VL having an amino acid sequence having at least 95% identity to an amino acid sequence of SEQ ID NO:2820. In one aspect, provided herein is an antibody that binds TRDV2, comprising a heavy chain having an amino acid sequence having at least 95% identity to an amino acid sequence of SEQ ID NO:2821. In one aspect, provided herein is an antibody that binds TRDV2, comprising a light chain having an amino acid sequence having at least 95% identity to an amino acid sequence of SEQ ID NO:2822. In one aspect, provided herein is an antibody that binds TRDV2, comprising a heavy chain having an amino acid sequence having at least 95% identity to an amino acid sequence of SEQ ID NO:2821, and a light chain having an amino acid sequence having at least 95% identity to an amino acid sequence of SEQ ID NO:2822.

In one aspect, provided herein is an antibody that binds TRDV2, comprising: (i) a VH comprising a VH CDR1, a VH CDR2, and a VH CDR3 having an amino acid sequence of SEQ ID NOs:2823, 2824, and 2825, respectively, and (ii) a VL comprising a VL CDR1, VL CDR2, and VL CDR3 having an amino acid sequence of SEQ ID NOs:2826, 2827, and 2828, respectively. In one aspect, provided herein is an antibody that binds TRDV2, comprising: (i) a VH comprising a VH CDR1, a VH CDR2, and a VH CDR3 having an amino acid sequence of SEQ ID NOs:2829, 2830, and 2831, respectively, and (ii) a VL comprising a VL CDR1, VL CDR2, and VL CDR3 having an amino acid sequence of SEQ ID NOs:2832, 2833, and 2834, respectively. In one aspect, provided herein is an antibody that binds TRDV2, comprising: (i) a VH comprising a VH CDR1, a VH CDR2, and a VH CDR3 having an amino acid sequence of SEQ ID NOs:2835, 2836, and 2837, respectively, and (ii) a VL comprising a VL CDR1, VL CDR2, and VL CDR3 having an amino acid sequence of SEQ ID NOs:2838, 2839, and 2840, respectively. In one aspect, provided herein is an antibody that binds TRDV2, comprising: (i) a VH comprising a VH CDR1, a VH CDR2, and a VH CDR3 having an amino acid sequence of SEQ ID NOs:2841, 2842, and 2843, respectively, and (ii) a VL comprising a VL CDR1, VL CDR2, and VL CDR3 having an amino acid sequence of SEQ ID NOs:2844, 2845, and 2846, respectively. In one aspect, provided herein is an antibody that binds TRDV2, comprising: (i) a VH comprising a VH CDR1, a VH CDR2, and a VH CDR3 having an amino acid sequence of SEQ ID NOs:2847, 2848, and 2849, respectively, and (ii) a VL comprising a VL CDR1, VL CDR2, and VL CDR3 having an amino acid sequence of SEQ ID NOs:2850, 2851, and 2852, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2853; and (ii) a VL comprising a VL CDR1, a VL CDR2, and a VL CDR3 having an amino acid sequence of a VL CDR1, a VL CDR2, and a VL CDR3, respectively, of SEQ ID NO:2854. In one aspect, provided herein is an antibody that binds TRDV2, comprising a VH having an amino acid sequence of SEQ ID NO:2853. In one aspect, provided herein is an antibody that binds TRDV2, comprising a VL having an amino acid sequence of SEQ ID NO:2854. In one aspect, provided herein is an antibody that binds TRDV2, comprising a VH having an amino acid sequence of SEQ ID NO:2853, and a VL having an amino acid sequence of SEQ ID NO:2854. In one aspect, provided herein is an antibody that binds TRDV2, comprising a heavy chain having an amino acid sequence of SEQ ID NO:2855. In one aspect, provided herein is an antibody that binds TRDV2, comprising a light chain having an amino acid sequence of SEQ ID NO:2856. In one aspect, provided herein is an antibody that binds TRDV2, comprising a heavy chain having an amino acid sequence of SEQ ID NO:2855, and a light chain having an amino acid sequence of SEQ ID NO:2856. In one aspect, provided herein is an antibody that binds TRDV2, comprising a VH having an amino acid sequence having at least 95% identity to an amino acid sequence of SEQ ID NO:2853. In one aspect, provided herein is an antibody that binds TRDV2, comprising a VL having an amino acid sequence having at least 95% identity to an amino acid sequence of SEQ ID NO:2854. In one aspect, provided herein is an antibody that binds TRDV2, comprising a VH having an amino acid sequence having at least 95% identity to an amino acid sequence of SEQ ID NO:2853, and a VL having an amino acid sequence having at least 95% identity to an amino acid sequence of SEQ ID NO:2854. In one aspect, provided herein is an antibody that binds TRDV2, comprising a heavy chain having an amino acid sequence having at least 95% identity to an amino acid sequence of SEQ ID NO:2855. In one aspect, provided herein is an antibody that binds TRDV2, comprising a light chain having an amino acid sequence having at least 95% identity to an amino acid sequence of SEQ ID NO:2856. In one aspect, provided herein is an antibody that binds TRDV2, comprising a heavy chain having an amino acid sequence having at least 95% identity to an amino acid sequence of SEQ ID NO:2855, and a light chain having an amino acid sequence having at least 95% identity to an amino acid sequence of SEQ ID NO:2856.

In one aspect, provided herein is an antibody that binds TRDV2, comprising: (i) a VH comprising a VH CDR1, a VH CDR2, and a VH CDR3 having an amino acid sequence of SEQ ID NOs:2857, 2858, and 2859, respectively, and (ii) a VL comprising a VL CDR1, VL CDR2, and VL CDR3 having an amino acid sequence of SEQ ID NOs:2860, 2861, and 2862, respectively. In one aspect, provided herein is an antibody that binds TRDV2, comprising: (i) a VH comprising a VH CDR1, a VH CDR2, and a VH CDR3 having an amino acid sequence of SEQ ID NOs:2863, 2864, and 2865, respectively, and (ii) a VL comprising a VL CDR1, VL CDR2, and VL CDR3 having an amino acid sequence of SEQ ID NOs:2866, 2867, and 2868, respectively. In one aspect, provided herein is an antibody that binds TRDV2, comprising: (i) a VH comprising a VH CDR1, a VH CDR2, and a VH CDR3 having an amino acid sequence of SEQ ID NOs:2869, 2870, and 2871, respectively, and (ii) a VL comprising a VL CDR1, VL CDR2, and VL CDR3 having an amino acid sequence of SEQ ID NOs:2872, 2873, and 2874, respectively. In one aspect, provided herein is an antibody that binds TRDV2, comprising: (i) a VH comprising a VH CDR1, a VH CDR2, and a VH CDR3 having an amino acid sequence of SEQ ID NOs:2875, 2876, and 2877, respectively, and (ii) a VL comprising a VL CDR1, VL CDR2, and VL CDR3 having an amino acid sequence of SEQ ID NOs:2878, 2879, and 2880, respectively. In one aspect, provided herein is an antibody that binds TRDV2, comprising: (i) a VH comprising a VH CDR1, a VH CDR2, and a VH CDR3 having an amino acid sequence of SEQ ID NOs:2881, 2882, and 2883, respectively, and (ii) a VL comprising a VL CDR1, VL CDR2, and VL CDR3 having an amino acid sequence of SEQ ID NOs:2884, 2885, and 2886, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2887; and (ii) a VL comprising a VL CDR1, a VL CDR2, and a VL CDR3 having an amino acid sequence of a VL CDR1, a VL CDR2, and a VL CDR3, respectively, of SEQ ID NO:2888. In one aspect, provided herein is an antibody that binds TRDV2, comprising a VH having an amino acid sequence of SEQ ID NO:2887. In one aspect, provided herein is an antibody that binds TRDV2, comprising a VL having an amino acid sequence of SEQ ID NO:2888. In one aspect, provided herein is an antibody that binds TRDV2, comprising a VH having an amino acid sequence of SEQ ID NO:2887, and a VL having an amino acid sequence of SEQ ID NO:2888. In one aspect, provided herein is an antibody that binds TRDV2, comprising a heavy chain having an amino acid sequence of SEQ ID NO:2889. In one aspect, provided herein is an antibody that binds TRDV2, comprising a light chain having an amino acid sequence of SEQ ID NO:2890. In one aspect, provided herein is an antibody that binds TRDV2, comprising a heavy chain having an amino acid sequence of SEQ ID NO:2889, and a light chain having an amino acid sequence of SEQ ID NO:2890. In one aspect, provided herein is an antibody that binds TRDV2, comprising a VH having an amino acid sequence having at least 95% identity to an amino acid sequence of SEQ ID NO:2887. In one aspect, provided herein is an antibody that binds TRDV2, comprising a VL having an amino acid sequence having at least 95% identity to an amino acid sequence of SEQ ID NO:2888. In one aspect, provided herein is an antibody that binds TRDV2, comprising a VH having an amino acid sequence having at least 95% identity to an amino acid sequence of SEQ ID NO:2887, and a VL having an amino acid sequence having at least 95% identity to an amino acid sequence of SEQ ID NO:2888. In one aspect, provided herein is an antibody that binds TRDV2, comprising a heavy chain having an amino acid sequence having at least 95% identity to an amino acid sequence of SEQ ID NO:2889. In one aspect, provided herein is an antibody that binds TRDV2, comprising a light chain having an amino acid sequence having at least 95% identity to an amino acid sequence of SEQ ID NO:2890. In one aspect, provided herein is an antibody that binds TRDV2, comprising a heavy chain having an amino acid sequence having at least 95% identity to an amino acid sequence of SEQ ID NO:2889, and a light chain having an amino acid sequence having at least 95% identity to an amino acid sequence of SEQ ID NO:2890.

In one aspect, provided herein is an antibody that binds TRDV2, comprising: (i) a VH comprising a VH CDR1, a VH CDR2, and a VH CDR3 having an amino acid sequence of SEQ ID NOs:2891, 2892, and 2893, respectively, and (ii) a VL comprising a VL CDR1, VL CDR2, and VL CDR3 having an amino acid sequence of SEQ ID NOs:2894, 2895, and 2896, respectively. In one aspect, provided herein is an antibody that binds TRDV2, comprising: (i) a VH comprising a VH CDR1, a VH CDR2, and a VH CDR3 having an amino acid sequence of SEQ ID NOs:2897, 2898, and 2899, respectively, and (ii) a VL comprising a VL CDR1, VL CDR2, and VL CDR3 having an amino acid sequence of SEQ ID NOs:2900, 2901, and 2902, respectively. In one aspect, provided herein is an antibody that binds TRDV2, comprising: (i) a VH comprising a VH CDR1, a VH CDR2, and a VH CDR3 having an amino acid sequence of SEQ ID NOs:2903, 2904, and 2905, respectively, and (ii) a VL comprising a VL CDR1, VL CDR2, and VL CDR3 having an amino acid sequence of SEQ ID NOs:2906, 2907, and 2908, respectively. In one aspect, provided herein is an antibody that binds TRDV2, comprising: (i) a VH comprising a VH CDR1, a VH CDR2, and a VH CDR3 having an amino acid sequence of SEQ ID NOs:2909, 2910, and 2911, respectively, and (ii) a VL comprising a VL CDR1, VL CDR2, and VL CDR3 having an amino acid sequence of SEQ ID NOs:2912, 2913, and 2914, respectively. In one aspect, provided herein is an antibody that binds TRDV2, comprising: (i) a VH comprising a VH CDR1, a VH CDR2, and a VH CDR3 having an amino acid sequence of SEQ ID NOs:2915, 2916, and 2917, respectively, and (ii) a VL comprising a VL CDR1, VL CDR2, and VL CDR3 having an amino acid sequence of SEQ ID NOs:2918, 2919, and 2920, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2921; and (ii) a VL comprising a VL CDR1, a VL CDR2, and a VL CDR3 having an amino acid sequence of a VL CDR1, a VL CDR2, and a VL CDR3, respectively, of SEQ ID NO:2922. In one aspect, provided herein is an antibody that binds TRDV2, comprising a VH having an amino acid sequence of SEQ ID NO:2921. In one aspect, provided herein is an antibody that binds TRDV2, comprising a VL having an amino acid sequence of SEQ ID NO:2922. In one aspect, provided herein is an antibody that binds TRDV2, comprising a VH having an amino acid sequence of SEQ ID NO:2921, and a VL having an amino acid sequence of SEQ ID NO:2922. In one aspect, provided herein is an antibody that binds TRDV2, comprising a heavy chain having an amino acid sequence of SEQ ID NO:2923. In one aspect, provided herein is an antibody that binds TRDV2, comprising a light chain having an amino acid sequence of SEQ ID NO:2924. In one aspect, provided herein is an antibody that binds TRDV2, comprising a heavy chain having an amino acid sequence of SEQ ID NO:2923, and a light chain having an amino acid sequence of SEQ ID NO:2924. In one aspect, provided herein is an antibody that binds TRDV2, comprising a VH having an amino acid sequence having at least 95% identity to an amino acid sequence of SEQ ID NO:2921. In one aspect, provided herein is an antibody that binds TRDV2, comprising a VL having an amino acid sequence having at least 95% identity to an amino acid sequence of SEQ ID NO:2922. In one aspect, provided herein is an antibody that binds TRDV2, comprising a VH having an amino acid sequence having at least 95% identity to an amino acid sequence of SEQ ID NO:2921, and a VL having an amino acid sequence having at least 95% identity to an amino acid sequence of SEQ ID NO:2922. In one aspect, provided herein is an antibody that binds TRDV2, comprising a heavy chain having an amino acid sequence having at least 95% identity to an amino acid sequence of SEQ ID NO:2923. In one aspect, provided herein is an antibody that binds TRDV2, comprising a light chain having an amino acid sequence having at least 95% identity to an amino acid sequence of SEQ ID NO:2924. In one aspect, provided herein is an antibody that binds TRDV2, comprising a heavy chain having an amino acid sequence having at least 95% identity to an amino acid sequence of SEQ ID NO:2923, and a light chain having an amino acid sequence having at least 95% identity to an amino acid sequence of SEQ ID NO:2924.

In one aspect, provided herein is an antibody that binds TRDV2, comprising: (i) a VH comprising a VH CDR1, a VH CDR2, and a VH CDR3 having an amino acid sequence of SEQ ID NOs:2925, 2926, and 2927, respectively, and (ii) a VL comprising a VL CDR1, VL CDR2, and VL CDR3 having an amino acid sequence of SEQ ID NOs:2928, 2929, and 2930, respectively. In one aspect, provided herein is an antibody that binds TRDV2, comprising: (i) a VH comprising a VH CDR1, a VH CDR2, and a VH CDR3 having an amino acid sequence of SEQ ID NOs:2931, 2932, and 2933, respectively, and (ii) a VL comprising a VL CDR1, VL CDR2, and VL CDR3 having an amino acid sequence of SEQ ID NOs:2934, 2935, and 2936, respectively. In one aspect, provided herein is an antibody that binds TRDV2, comprising: (i) a VH comprising a VH CDR1, a VH CDR2, and a VH CDR3 having an amino acid sequence of SEQ ID NOs:2937, 2938, and 2939, respectively, and (ii) a VL comprising a VL CDR1, VL CDR2, and VL CDR3 having an amino acid sequence of SEQ ID NOs:2940, 2941, and 2942, respectively. In one aspect, provided herein is an antibody that binds TRDV2, comprising: (i) a VH comprising a VH CDR1, a VH CDR2, and a VH CDR3 having an amino acid sequence of SEQ ID NOs:2943, 2944, and 2945, respectively, and (ii) a VL comprising a VL CDR1, VL CDR2, and VL CDR3 having an amino acid sequence of SEQ ID NOs:2946, 2947, and 2948, respectively. In one aspect, provided herein is an antibody that binds TRDV2, comprising: (i) a VH comprising a VH CDR1, a VH CDR2, and a VH CDR3 having an amino acid sequence of SEQ ID NOs:2949, 2950, and 2951, respectively, and (ii) a VL comprising a VL CDR1, VL CDR2, and VL CDR3 having an amino acid sequence of SEQ ID NOs:2952, 2953, and 2954, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2955; and (ii) a VL comprising a VL CDR1, a VL CDR2, and a VL CDR3 having an amino acid sequence of a VL CDR1, a VL CDR2, and a VL CDR3, respectively, of SEQ ID NO:2956. In one aspect, provided herein is an antibody that binds TRDV2, comprising a VH having an amino acid sequence of SEQ ID NO:2955. In one aspect, provided herein is an antibody that binds TRDV2, comprising a VL having an amino acid sequence of SEQ ID NO:2956. In one aspect, provided herein is an antibody that binds TRDV2, comprising a VH having an amino acid sequence of SEQ ID NO:2955, and a VL having an amino acid sequence of SEQ ID NO:2956. In one aspect, provided herein is an antibody that binds TRDV2, comprising a heavy chain having an amino acid sequence of SEQ ID NO:2957. In one aspect, provided herein is an antibody that binds TRDV2, comprising a light chain having an amino acid sequence of SEQ ID NO:2958. In one aspect, provided herein is an antibody that binds TRDV2, comprising a heavy chain having an amino acid sequence of SEQ ID NO:2957, and a light chain having an amino acid sequence of SEQ ID NO:2958. In one aspect, provided herein is an antibody that binds TRDV2, comprising a VH having an amino acid sequence having at least 95% identity to an amino acid sequence of SEQ ID NO:2955. In one aspect, provided herein is an antibody that binds TRDV2, comprising a VL having an amino acid sequence having at least 95% identity to an amino acid sequence of SEQ ID NO:2956. In one aspect, provided herein is an antibody that binds TRDV2, comprising a VH having an amino acid sequence having at least 95% identity to an amino acid sequence of SEQ ID NO:2955, and a VL having an amino acid sequence having at least 95% identity to an amino acid sequence of SEQ ID NO:2956. In one aspect, provided herein is an antibody that binds TRDV2, comprising a heavy chain having an amino acid sequence having at least 95% identity to an amino acid sequence of SEQ ID NO:2957. In one aspect, provided herein is an antibody that binds TRDV2, comprising a light chain having an amino acid sequence having at least 95% identity to an amino acid sequence of SEQ ID NO:2958. In one aspect, provided herein is an antibody that binds TRDV2, comprising a heavy chain having an amino acid sequence having at least 95% identity to an amino acid sequence of SEQ ID NO:2957, and a light chain having an amino acid sequence having at least 95% identity to an amino acid sequence of SEQ ID NO:2958.

In one aspect, provided herein is an antibody that binds TRDV2, comprising: (i) a VH comprising a VH CDR1, a VH CDR2, and a VH CDR3 having an amino acid sequence of SEQ ID NOs:2959, 2960, and 2961, respectively, and (ii) a VL comprising a VL CDR1, VL CDR2, and VL CDR3 having an amino acid sequence of SEQ ID NOs:2962, 2963, and 2964, respectively. In one aspect, provided herein is an antibody that binds TRDV2, comprising: (i) a VH comprising a VH CDR1, a VH CDR2, and a VH CDR3 having an amino acid sequence of SEQ ID NOs:2965, 2966, and 2967, respectively, and (ii) a VL comprising a VL CDR1, VL CDR2, and VL CDR3 having an amino acid sequence of SEQ ID NOs:2968, 2969, and 2970, respectively. In one aspect, provided herein is an antibody that binds TRDV2, comprising: (i) a VH comprising a VH CDR1, a VH CDR2, and a VH CDR3 having an amino acid sequence of SEQ ID NOs:2971, 2972, and 2973, respectively, and (ii) a VL comprising a VL CDR1, VL CDR2, and VL CDR3 having an amino acid sequence of SEQ ID NOs:2974, 2975, and 2976, respectively. In one aspect, provided herein is an antibody that binds TRDV2, comprising: (i) a VH comprising a VH CDR1, a VH CDR2, and a VH CDR3 having an amino acid sequence of SEQ ID NOs:2977, 2978, and 2979, respectively, and (ii) a VL comprising a VL CDR1, VL CDR2, and VL CDR3 having an amino acid sequence of SEQ ID NOs:2980, 2981, and 2982, respectively. In one aspect, provided herein is an antibody that binds TRDV2, comprising: (i) a VH comprising a VH CDR1, a VH CDR2, and a VH CDR3 having an amino acid sequence of SEQ ID NOs:2983, 2984, and 2985, respectively, and (ii) a VL comprising a VL CDR1, VL CDR2, and VL CDR3 having an amino acid sequence of SEQ ID NOs:2986, 2987, and 2988, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2989; and (ii) a VL comprising a VL CDR1, a VL CDR2, and a VL CDR3 having an amino acid sequence of a VL CDR1, a VL CDR2, and a VL CDR3, respectively, of SEQ ID NO:2990. In one aspect, provided herein is an antibody that binds TRDV2, comprising a VH having an amino acid sequence of SEQ ID NO:2989. In one aspect, provided herein is an antibody that binds TRDV2, comprising a VL having an amino acid sequence of SEQ ID NO:2990. In one aspect, provided herein is an antibody that binds TRDV2, comprising a VH having an amino acid sequence of SEQ ID NO:2989, and a VL having an amino acid sequence of SEQ ID NO:2990. In one aspect, provided herein is an antibody that binds TRDV2, comprising a heavy chain having an amino acid sequence of SEQ ID NO:2991. In one aspect, provided herein is an antibody that binds TRDV2, comprising a light chain having an amino acid sequence of SEQ ID NO:2992. In one aspect, provided herein is an antibody that binds TRDV2, comprising a heavy chain having an amino acid sequence of SEQ ID NO:2991, and a light chain having an amino acid sequence of SEQ ID NO:2992. In one aspect, provided herein is an antibody that binds TRDV2, comprising a VH having an amino acid sequence having at least 95% identity to an amino acid sequence of SEQ ID NO:2989. In one aspect, provided herein is an antibody that binds TRDV2, comprising a VL having an amino acid sequence having at least 95% identity to an amino acid sequence of SEQ ID NO:2990. In one aspect, provided herein is an antibody that binds TRDV2, comprising a VH having an amino acid sequence having at least 95% identity to an amino acid sequence of SEQ ID NO:2989, and a VL having an amino acid sequence having at least 95% identity to an amino acid sequence of SEQ ID NO:2990. In one aspect, provided herein is an antibody that binds TRDV2, comprising a heavy chain having an amino acid sequence having at least 95% identity to an amino acid sequence of SEQ ID NO:2991. In one aspect, provided herein is an antibody that binds TRDV2, comprising a light chain having an amino acid sequence having at least 95% identity to amino acid sequence of SEQ ID NO:2992. In one aspect, provided herein is an antibody that binds TRDV2, comprising a heavy chain having an amino acid sequence having at least 95% identity to an amino acid sequence of SEQ ID NO:2991, and a light chain having an amino acid sequence having at least 95% identity to an amino acid sequence of SEQ ID NO:2992.

In one aspect, provided herein is an antibody that binds TRDV2, comprising: (i) a VH comprising a VH CDR1, a VH CDR2, and a VH CDR3 having an amino acid sequence of SEQ ID NOs:2993, 2994, and 2995, respectively, and (ii) a VL comprising a VL CDR1, VL CDR2, and VL CDR3 having an amino acid sequence of SEQ ID NOs:2996, 2997, and 2998, respectively. In one aspect, provided herein is an antibody that binds TRDV2, comprising: (i) a VH comprising a VH CDR1, a VH CDR2, and a VH CDR3 having an amino acid sequence of SEQ ID NOs:2999, 3000, and 3001, respectively, and (ii) a VL comprising a VL CDR1, VL CDR2, and VL CDR3 having an amino acid sequence of SEQ ID NOs:3002, 3003, and 3004, respectively. In one aspect, provided herein is an antibody that binds TRDV2, comprising: (i) a VH comprising a VH CDR1, a VH CDR2, and a VH CDR3 having an amino acid sequence of SEQ ID NOs:3005, 3006, and 3007, respectively, and (ii) a VL comprising a VL CDR1, VL CDR2, and VL CDR3 having an amino acid sequence of SEQ ID NOs:3008, 3009, and 3010, respectively. In one aspect, provided herein is an antibody that binds TRDV2, comprising: (i) a VH comprising a VH CDR1, a VH CDR2, and a VH CDR3 having an amino acid sequence of SEQ ID NOs:3011, 3012, and 3013, respectively, and (ii) a VL comprising a VL CDR1, VL CDR2, and VL CDR3 having an amino acid sequence of SEQ ID NOs:3014, 3015, and 3016, respectively. In one aspect, provided herein is an antibody that binds TRDV2, comprising: (i) a VH comprising a VH CDR1, a VH CDR2, and a VH CDR3 having an amino acid sequence of SEQ ID NOs:3017, 3018, and 3019, respectively, and (ii) a VL comprising a VL CDR1, VL CDR2, and VL CDR3 having an amino acid sequence of SEQ ID NOs:3020, 3021, and 3022, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3023; and (ii) a VL comprising a VL CDR1, a VL CDR2, and a VL CDR3 having an amino acid sequence of a VL CDR1, a VL CDR2, and a VL CDR3, respectively, of SEQ ID NO:3024. In one aspect, provided herein is an antibody that binds TRDV2, comprising a VH having an amino acid sequence of SEQ ID NO:3023. In one aspect, provided herein is an antibody that binds TRDV2, comprising a VL having an amino acid sequence of SEQ ID NO:3024. In one aspect, provided herein is an antibody that binds TRDV2, comprising a VH having an amino acid sequence of SEQ ID NO:3023, and a VL having an amino acid sequence of SEQ ID NO:3024. In one aspect, provided herein is an antibody that binds TRDV2, comprising a heavy chain having an amino acid sequence of SEQ ID NO:3025. In one aspect, provided herein is an antibody that binds TRDV2, comprising a light chain having an amino acid sequence of SEQ ID NO:3026. In one aspect, provided herein is an antibody that binds TRDV2, comprising a heavy chain having an amino acid sequence of SEQ ID NO:3025, and a light chain having an amino acid sequence of SEQ ID NO:3026. In one aspect, provided herein is an antibody that binds TRDV2, comprising a VH having an amino acid sequence having at least 95% identity to an amino acid sequence of SEQ ID NO:3023. In one aspect, provided herein is an antibody that binds TRDV2, comprising a VL having an amino acid sequence having at least 95% identity to an amino acid sequence of SEQ ID NO:3024. In one aspect, provided herein is an antibody that binds TRDV2, comprising a VH having an amino acid sequence having at least 95% identity to an amino acid sequence of SEQ ID NO:3023, and a VL having an amino acid sequence having at least 95% identity to an amino acid sequence of SEQ ID NO:3024. In one aspect, provided herein is an antibody that binds TRDV2, comprising a heavy chain having an amino acid sequence having at least 95% identity to an amino acid sequence of SEQ ID NO:3025. In one aspect, provided herein is an antibody that binds TRDV2, comprising a light chain having an amino acid sequence having at least 95% identity to an amino acid sequence of SEQ ID NO:3026. In one aspect, provided herein is an antibody that binds TRDV2, comprising a heavy chain having an amino acid sequence having at least 95% identity to an amino acid sequence of SEQ ID NO:3025, and a light chain having an amino acid sequence having at least 95% identity to an amino acid sequence of SEQ ID NO:3026.

In one aspect, provided herein is an antibody that binds TRDV2, comprising: (i) a VH comprising a VH CDR1, a VH CDR2, and a VH CDR3 having an amino acid sequence of SEQ ID NOs:3027, 3028, and 3029, respectively, and (ii) a VL comprising a VL CDR1, VL CDR2, and VL CDR3 having an amino acid sequence of SEQ ID NOs:3030, 3031, and 3032, respectively. In one aspect, provided herein is an antibody that binds TRDV2, comprising: (i) a VH comprising a VH CDR1, a VH CDR2, and a VH CDR3 having an amino acid sequence of SEQ ID NOs:3033, 3034, and 3035, respectively, and (ii) a VL comprising a VL CDR1, VL CDR2, and VL CDR3 having an amino acid sequence of SEQ ID NOs:3036, 3037, and 3038, respectively. In one aspect, provided herein is an antibody that binds TRDV2, comprising: (i) a VH comprising a VH CDR1, a VH CDR2, and a VH CDR3 having an amino acid sequence of SEQ ID NOs:3039, 3040, and 3041, respectively, and (ii) a VL comprising a VL CDR1, VL CDR2, and VL CDR3 having an amino acid sequence of SEQ ID NOs:3042, 3043, and 3044, respectively. In one aspect, provided herein is an antibody that binds TRDV2, comprising: (i) a VH comprising a VH CDR1, a VH CDR2, and a VH CDR3 having an amino acid sequence of SEQ ID NOs:3045, 3046, and 3047, respectively, and (ii) a VL comprising a VL CDR1, VL CDR2, and VL CDR3 having an amino acid sequence of SEQ ID NOs:3048, 3049, and 3050, respectively. In one aspect, provided herein is an antibody that binds TRDV2, comprising: (i) a VH comprising a VH CDR1, a VH CDR2, and a VH CDR3 having an amino acid sequence of SEQ ID NOs:3051, 3052, and 3053, respectively, and (ii) a VL comprising a VL CDR1, VL CDR2, and VL CDR3 having an amino acid sequence of SEQ ID NOs:3054, 3055, and 3056, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3057; and (ii) a VL comprising a VL CDR1, a VL CDR2, and a VL CDR3 having an amino acid sequence of a VL CDR1, a VL CDR2, and a VL CDR3, respectively, of SEQ ID NO:3058. In one aspect, provided herein is an antibody that binds TRDV2, comprising a VH having an amino acid sequence of SEQ ID NO:3057. In one aspect, provided herein is an antibody that binds TRDV2, comprising a VL having an amino acid sequence of SEQ ID NO:3058. In one aspect, provided herein is an antibody that binds TRDV2, comprising a VH having an amino acid sequence of SEQ ID NO:3057, and a VL having an amino acid sequence of SEQ ID NO:3058. In one aspect, provided herein is an antibody that binds TRDV2, comprising a heavy chain having an amino acid sequence of SEQ ID NO:3059. In one aspect, provided herein is an antibody that binds TRDV2, comprising a light chain having an amino acid sequence of SEQ ID NO:3060. In one aspect, provided herein is an antibody that binds TRDV2, comprising a heavy chain having an amino acid sequence of SEQ ID NO:3059, and a light chain having an amino acid sequence of SEQ ID NO:3060. In one aspect, provided herein is an antibody that binds TRDV2, comprising a VH having an amino acid sequence having at least 95% identity to an amino acid sequence of SEQ ID NO:3057. In one aspect, provided herein is an antibody that binds TRDV2, comprising a VL having an amino acid sequence having at least 95% identity to an amino acid sequence of SEQ ID NO:3058. In one aspect, provided herein is an antibody that binds TRDV2, comprising a VH having an amino acid sequence having at least 95% identity to an amino acid sequence of SEQ ID NO:3057, and a VL having an amino acid sequence having at least 95% identity to an amino acid sequence of SEQ ID NO:3058. In one aspect, provided herein is an antibody that binds TRDV2, comprising a heavy chain having an amino acid sequence having at least 95% identity to an amino acid sequence of SEQ ID NO:3059. In one aspect, provided herein is an antibody that binds TRDV2, comprising a light chain having an amino acid sequence having at least 95% identity to an amino acid sequence of SEQ ID NO:3060. In one aspect, provided herein is an antibody that binds TRDV2, comprising a heavy chain having an amino acid sequence having at least 95% identity to an amino acid sequence of SEQ ID NO:3059, and a light chain having an amino acid sequence having at least 95% identity to an amino acid sequence of SEQ ID NO:3060.

In one aspect, provided herein is an antibody that binds TRDV2, comprising: (i) a VH comprising a VH CDR1, a VH CDR2, and a VH CDR3 having an amino acid sequence of SEQ ID NOs:3061, 3062, and 3063, respectively, and (ii) a VL comprising a VL CDR1, VL CDR2, and VL CDR3 having an amino acid sequence of SEQ ID NOs:3064, 3065, and 3066, respectively. In one aspect, provided herein is an antibody that binds TRDV2, comprising: (i) a VH comprising a VH CDR1, a VH CDR2, and a VH CDR3 having an amino acid sequence of SEQ ID NOs:3067, 3068, and 3069, respectively, and (ii) a VL comprising a VL CDR1, VL CDR2, and VL CDR3 having an amino acid sequence of SEQ ID NOs:3070, 3071, and 3072, respectively. In one aspect, provided herein is an antibody that binds TRDV2, comprising: (i) a VH comprising a VH CDR1, a VH CDR2, and a VH CDR3 having an amino acid sequence of SEQ ID NOs:3073, 3074, and 3075, respectively, and (ii) a VL comprising a VL CDR1, VL CDR2, and VL CDR3 having an amino acid sequence of SEQ ID NOs:3076, 3077, and 3078, respectively. In one aspect, provided herein is an antibody that binds TRDV2, comprising: (i) a VH comprising a VH CDR1, a VH CDR2, and a VH CDR3 having an amino acid sequence of SEQ ID NOs:3079, 3080, and 3081, respectively, and (ii) a VL comprising a VL CDR1, VL CDR2, and VL CDR3 having an amino acid sequence of SEQ ID NOs:3082, 3083, and 3084, respectively. In one aspect, provided herein is an antibody that binds TRDV2, comprising: (i) a VH comprising a VH CDR1, a VH CDR2, and a VH CDR3 having an amino acid sequence of SEQ ID NOs:3085, 3086, and 3087, respectively, and (ii) a VL comprising a VL CDR1, VL CDR2, and VL CDR3 having an amino acid sequence of SEQ ID NOs:3088, 3089, and 3090, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3091; and (ii) a VL comprising a VL CDR1, a VL CDR2, and a VL CDR3 having an amino acid sequence of a VL CDR1, a VL CDR2, and a VL CDR3, respectively, of SEQ ID NO:3092. In one aspect, provided herein is an antibody that binds TRDV2, comprising a VH having an amino acid sequence of SEQ ID NO:3091. In one aspect, provided herein is an antibody that binds TRDV2, comprising a VL having an amino acid sequence of SEQ ID NO:3092. In one aspect, provided herein is an antibody that binds TRDV2, comprising a VH having an amino acid sequence of SEQ ID NO:3091, and a VL having an amino acid sequence of SEQ ID NO:3092. In one aspect, provided herein is an antibody that binds TRDV2, comprising a heavy chain having an amino acid sequence of SEQ ID NO:3093. In one aspect, provided herein is an antibody that binds TRDV2, comprising a light chain having an amino acid sequence of SEQ ID NO:3094. In one aspect, provided herein is an antibody that binds TRDV2, comprising a heavy chain having an amino acid sequence of SEQ ID NO:3093, and a light chain having an amino acid sequence of SEQ ID NO:3094. In one aspect, provided herein is an antibody that binds TRDV2, comprising a VH having an amino acid sequence having at least 95% identity to an amino acid sequence of SEQ ID NO:3091. In one aspect, provided herein is an antibody that binds TRDV2, comprising a VL having an amino acid sequence having at least 95% identity to an amino acid sequence of SEQ ID NO:3092. In one aspect, provided herein is an antibody that binds TRDV2, comprising a VH having an amino acid sequence having at least 95% identity to an amino acid sequence of SEQ ID NO:3091, and a VL having an amino acid sequence having at least 95% identity to an amino acid sequence of SEQ ID NO:3092. In one aspect, provided herein is an antibody that binds TRDV2, comprising a heavy chain having an amino acid sequence having at least 95% identity to an amino acid sequence of SEQ ID NO:3093. In one aspect, provided herein is an antibody that binds TRDV2, comprising a light chain having an amino acid sequence having at least 95% identity to an amino acid sequence of SEQ ID NO:3094. In one aspect, provided herein is an antibody that binds TRDV2, comprising a heavy chain having an amino acid sequence having at least 95% identity to an amino acid sequence of SEQ ID NO:3093, and a light chain having an amino acid sequence having at least 95% identity to an amino acid sequence of SEQ ID NO:3094.

In one aspect, provided herein is an antibody that binds TRDV2, comprising: (i) a VH comprising a VH CDR1, a VH CDR2, and a VH CDR3 having an amino acid sequence of SEQ ID NOs:3095, 3096, and 3097, respectively, and (ii) a VL comprising a VL CDR1, VL CDR2, and VL CDR3 having an amino acid sequence of SEQ ID NOs:3098, 3099, and 3100, respectively. In one aspect, provided herein is an antibody that binds TRDV2, comprising: (i) a VH comprising a VH CDR1, a VH CDR2, and a VH CDR3 having an amino acid sequence of SEQ ID NOs:3101, 3102, and 3103, respectively, and (ii) a VL comprising a VL CDR1, VL CDR2, and VL CDR3 having an amino acid sequence of SEQ ID NOs:3104, 3105, and 3106, respectively. In one aspect, provided herein is an antibody that binds TRDV2, comprising: (i) a VH comprising a VH CDR1, a VH CDR2, and a VH CDR3 having an amino acid sequence of SEQ ID NOs:3107, 3108, and 3109, respectively, and (ii) a VL comprising a VL CDR1, VL CDR2, and VL CDR3 having an amino acid sequence of SEQ ID NOs:3110, 3111, and 3112, respectively. In one aspect, provided herein is an antibody that binds TRDV2, comprising: (i) a VH comprising a VH CDR1, a VH CDR2, and a VH CDR3 having an amino acid sequence of SEQ ID NOs:3113, 3114, and 3115, respectively, and (ii) a VL comprising a VL CDR1, VL CDR2, and VL CDR3 having an amino acid sequence of SEQ ID NOs:3116, 3117, and 3118, respectively. In one aspect, provided herein is an antibody that binds TRDV2, comprising: (i) a VH comprising a VH CDR1, a VH CDR2, and a VH CDR3 having an amino acid sequence of SEQ ID NOs:3119, 3120, and 3121, respectively, and (ii) a VL comprising a VL CDR1, VL CDR2, and VL CDR3 having an amino acid sequence of SEQ ID NOs:3122, 3123, and 3124, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3125; and (ii) a VL comprising a VL CDR1, a VL CDR2, and a VL CDR3 having an amino acid sequence of a VL CDR1, a VL CDR2, and a VL CDR3, respectively, of SEQ ID NO:3126. In one aspect, provided herein is an antibody that binds TRDV2, comprising a VH having an amino acid sequence of SEQ ID NO:3125. In one aspect, provided herein is an antibody that binds TRDV2, comprising a VL having an amino acid sequence of SEQ ID NO:3126. In one aspect, provided herein is an antibody that binds TRDV2, comprising a VH having an amino acid sequence of SEQ ID NO:3125, and a VL having an amino acid sequence of SEQ ID NO:3126. In one aspect, provided herein is an antibody that binds TRDV2, comprising a heavy chain having an amino acid sequence of SEQ ID NO:3127. In one aspect, provided herein is an antibody that binds TRDV2, comprising a light chain having an amino acid sequence of SEQ ID NO:3128. In one aspect, provided herein is an antibody that binds TRDV2, comprising a heavy chain having an amino acid sequence of SEQ ID NO:3127, and a light chain having an amino acid sequence of SEQ ID NO:3128. In one aspect, provided herein is an antibody that binds TRDV2, comprising a VH having an amino acid sequence having at least 95% identity to an amino acid sequence of SEQ ID NO:3125. In one aspect, provided herein is an antibody that binds TRDV2, comprising a VL having an amino acid sequence having at least 95% identity to an amino acid sequence of SEQ ID NO:3126. In one aspect, provided herein is an antibody that binds TRDV2, comprising a VH having an amino acid sequence having at least 95% identity to an amino acid sequence of SEQ ID NO:3125, and a VL having an amino acid sequence having at least 95% identity to an amino acid sequence of SEQ ID NO:3126. In one aspect, provided herein is an antibody that binds TRDV2, comprising a heavy chain having an amino acid sequence having at least 95% identity to an amino acid sequence of SEQ ID NO:3127. In one aspect, provided herein is an antibody that binds TRDV2, comprising a light chain having an amino acid sequence having at least 95% identity to an amino acid sequence of SEQ ID NO:3128. In one aspect, provided herein is an antibody that binds TRDV2, comprising a heavy chain having an amino acid sequence having at least 95% identity to an amino acid sequence of SEQ ID NO:3127, and a light chain having an amino acid sequence having at least 95% identity to an amino acid sequence of SEQ ID NO:3128.

In one aspect, provided herein is an antibody that binds TRDV2, comprising: (i) a VH comprising a VH CDR1, a VH CDR2, and a VH CDR3 having an amino acid sequence of SEQ ID NOs:3129, 3130, and 3131, respectively, and (ii) a VL comprising a VL CDR1, VL CDR2, and VL CDR3 having an amino acid sequence of SEQ ID NOs:3132, 3133, and 3134, respectively. In one aspect, provided herein is an antibody that binds TRDV2, comprising: (i) a VH comprising a VH CDR1, a VH CDR2, and a VH CDR3 having an amino acid sequence of SEQ ID NOs:3135, 3136, and 3137, respectively, and (ii) a VL comprising a VL CDR1, VL CDR2, and VL CDR3 having an amino acid sequence of SEQ ID NOs:3138, 3139, and 3140, respectively. In one aspect, provided herein is an antibody that binds TRDV2, comprising: (i) a VH comprising a VH CDR1, a VH CDR2, and a VH CDR3 having an amino acid sequence of SEQ ID NOs:3141, 3142, and 3143, respectively, and (ii) a VL comprising a VL CDR1, VL CDR2, and VL CDR3 having an amino acid sequence of SEQ ID NOs:3144, 3145, and 3146, respectively. In one aspect, provided herein is an antibody that binds TRDV2, comprising: (i) a VH comprising a VH CDR1, a VH CDR2, and a VH CDR3 having an amino acid sequence of SEQ ID NOs:3147, 3148, and 3149, respectively, and (ii) a VL comprising a VL CDR1, VL CDR2, and VL CDR3 having an amino acid sequence of SEQ ID NOs:3150, 3151, and 3152, respectively. In one aspect, provided herein is an antibody that binds TRDV2, comprising: (i) a VH comprising a VH CDR1, a VH CDR2, and a VH CDR3 having an amino acid sequence of SEQ ID NOs:3153, 3154, and 3155, respectively, and (ii) a VL comprising a VL CDR1, VL CDR2, and VL CDR3 having an amino acid sequence of SEQ ID NOs:3156, 3157, and 3158, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3159; and (ii) a VL comprising a VL CDR1, a VL CDR2, and a VL CDR3 having an amino acid sequence of a VL CDR1, a VL CDR2, and a VL CDR3, respectively, of SEQ ID NO:3160. In one aspect, provided herein is an antibody that binds TRDV2, comprising a VH having an amino acid sequence of SEQ ID NO:3159. In one aspect, provided herein is an antibody that binds TRDV2, comprising a VL having an amino acid sequence of SEQ ID NO:3160. In one aspect, provided herein is an antibody that binds TRDV2, comprising a VH having an amino acid sequence of SEQ ID NO:3159, and a VL having an amino acid sequence of SEQ ID NO:3160. In one aspect, provided herein is an antibody that binds TRDV2, comprising a heavy chain having an amino acid sequence of SEQ ID NO:3161. In one aspect, provided herein is an antibody that binds TRDV2, comprising a light chain having an amino acid sequence of SEQ ID NO:3162. In one aspect, provided herein is an antibody that binds TRDV2, comprising a heavy chain having an amino acid sequence of SEQ ID NO:3161, and a light chain having an amino acid sequence of SEQ ID NO:3162. In one aspect, provided herein is an antibody that binds TRDV2, comprising a VH having an amino acid sequence having at least 95% identity to an amino acid sequence of SEQ ID NO:3159. In one aspect, provided herein is an antibody that binds TRDV2, comprising a VL having an amino acid sequence having at least 95% identity to an amino acid sequence of SEQ ID NO:3160. In one aspect, provided herein is an antibody that binds TRDV2, comprising a VH having an amino acid sequence having at least 95% identity to an amino acid sequence of SEQ ID NO:3159, and a VL having an amino acid sequence having at least 95% identity to an amino acid sequence of SEQ ID NO:3160. In one aspect, provided herein is an antibody that binds TRDV2, comprising a heavy chain having an amino acid sequence having at least 95% identity to an amino acid sequence of SEQ ID NO:3161. In one aspect, provided herein is an antibody that binds TRDV2, comprising a light chain having an amino acid sequence having at least 95% identity to an amino acid sequence of SEQ ID NO:3162. In one aspect, provided herein is an antibody that binds TRDV2, comprising a heavy chain having an amino acid sequence having at least 95% identity to an amino acid sequence of SEQ ID NO:3161, and a light chain having an amino acid sequence having at least 95% identity to an amino acid sequence of SEQ ID NO:3162.

In one aspect, provided herein is an antibody that binds TRDV2, comprising: (i) a VH comprising a VH CDR1, a VH CDR2, and a VH CDR3 having an amino acid sequence of SEQ ID NOs:3163, 3164, and 3165, respectively, and (ii) a VL comprising a VL CDR1, VL CDR2, and VL CDR3 having an amino acid sequence of SEQ ID NOs:3166, 3167, and 3168, respectively. In one aspect, provided herein is an antibody that binds TRDV2, comprising: (i) a VH comprising a VH CDR1, a VH CDR2, and a VH CDR3 having an amino acid sequence of SEQ ID NOs:3169, 3170, and 3171, respectively, and (ii) a VL comprising a VL CDR1, VL CDR2, and VL CDR3 having an amino acid sequence of SEQ ID NOs:3172, 3173, and 3174, respectively. In one aspect, provided herein is an antibody that binds TRDV2, comprising: (i) a VH comprising a VH CDR1, a VH CDR2, and a VH CDR3 having an amino acid sequence of SEQ ID NOs:3175, 3176, and 3177, respectively, and (ii) a VL comprising a VL CDR1, VL CDR2, and VL CDR3 having an amino acid sequence of SEQ ID NOs:3178, 3179, and 3180, respectively. In one aspect, provided herein is an antibody that binds TRDV2, comprising: (i) a VH comprising a VH CDR1, a VH CDR2, and a VH CDR3 having an amino acid sequence of SEQ ID NOs:3181, 3182, and 3183, respectively, and (ii) a VL comprising a VL CDR1, VL CDR2, and VL CDR3 having an amino acid sequence of SEQ ID NOs:3184, 3185, and 3186, respectively. In one aspect, provided herein is an antibody that binds TRDV2, comprising: (i) a VH comprising a VH CDR1, a VH CDR2, and a VH CDR3 having an amino acid sequence of SEQ ID NOs:3187, 3188, and 3189, respectively, and (ii) a VL comprising a VL CDR1, VL CDR2, and VL CDR3 having an amino acid sequence of SEQ ID NOs:3190, 3191, and 3192, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3193; and (ii) a VL comprising a VL CDR1, a VL CDR2, and a VL CDR3 having an amino acid sequence of a VL CDR1, a VL CDR2, and a VL CDR3, respectively, of SEQ ID NO:3194. In one aspect, provided herein is an antibody that binds TRDV2, comprising a VH having an amino acid sequence of SEQ ID NO:3193. In one aspect, provided herein is an antibody that binds TRDV2, comprising a VL having an amino acid sequence of SEQ ID NO:3194. In one aspect, provided herein is an antibody that binds TRDV2, comprising a VH having an amino acid sequence of SEQ ID NO:3193, and a VL having an amino acid sequence of SEQ ID NO:3194. In one aspect, provided herein is an antibody that binds TRDV2, comprising a heavy chain having an amino acid sequence of SEQ ID NO:3195. In one aspect, provided herein is an antibody that binds TRDV2, comprising a light chain having an amino acid sequence of SEQ ID NO:3196. In one aspect, provided herein is an antibody that binds TRDV2, comprising a heavy chain having an amino acid sequence of SEQ ID NO:3195, and a light chain having an amino acid sequence of SEQ ID NO:3196. In one aspect, provided herein is an antibody that binds TRDV2, comprising a VH having an amino acid sequence having at least 95% identity to an amino acid sequence of SEQ ID NO:3193. In one aspect, provided herein is an antibody that binds TRDV2, comprising a VL having an amino acid sequence having at least 95% identity to an amino acid sequence of SEQ ID NO:3194. In one aspect, provided herein is an antibody that binds TRDV2, comprising a VH having an amino acid sequence having at least 95% identity to an amino acid sequence of SEQ ID NO:3193, and a VL having an amino acid sequence having at least 95% identity to an amino acid sequence of SEQ ID NO:3194. In one aspect, provided herein is an antibody that binds TRDV2, comprising a heavy chain having an amino acid sequence having at least 95% identity to an amino acid sequence of SEQ ID NO:3195. In one aspect, provided herein is an antibody that binds TRDV2, comprising a light chain having an amino acid sequence having at least 95% identity to an amino acid sequence of SEQ ID NO:3196. In one aspect, provided herein is an antibody that binds TRDV2, comprising a heavy chain having an amino acid sequence having at least 95% identity to an amino acid sequence of SEQ ID NO:3195, and a light chain having an amino acid sequence having at least 95% identity to an amino acid sequence of SEQ ID NO:3196.

In one aspect, provided herein is an antibody that binds TRDV2, comprising: (i) a VH comprising a VH CDR1, a VH CDR2, and a VH CDR3 having an amino acid sequence of SEQ ID NOs:3197, 3198, and 3199, respectively, and (ii) a VL comprising a VL CDR1, VL CDR2, and VL CDR3 having an amino acid sequence of SEQ ID NOs:3200, 3201, and 3202, respectively. In one aspect, provided herein is an antibody that binds TRDV2, comprising: (i) a VH comprising a VH CDR1, a VH CDR2, and a VH CDR3 having an amino acid sequence of SEQ ID NOs:3203, 3204, and 3205, respectively, and (ii) a VL comprising a VL CDR1, VL CDR2, and VL CDR3 having an amino acid sequence of SEQ ID NOs:3206, 3207, and 3208, respectively. In one aspect, provided herein is an antibody that binds TRDV2, comprising: (i) a VH comprising a VH CDR1, a VH CDR2, and a VH CDR3 having an amino acid sequence of SEQ ID NOs:3209, 3210, and 3211, respectively, and (ii) a VL comprising a VL CDR1, VL CDR2, and VL CDR3 having an amino acid sequence of SEQ ID NOs:3212, 3213, and 3214, respectively. In one aspect, provided herein is an antibody that binds TRDV2, comprising: (i) a VH comprising a VH CDR1, a VH CDR2, and a VH CDR3 having an amino acid sequence of SEQ ID NOs:3215, 3216, and 3217, respectively, and (ii) a VL comprising a VL CDR1, VL CDR2, and VL CDR3 having an amino acid sequence of SEQ ID NOs:3218, 3219, and 3220, respectively. In one aspect, provided herein is an antibody that binds TRDV2, comprising: (i) a VH comprising a VH CDR1, a VH CDR2, and a VH CDR3 having an amino acid sequence of SEQ ID NOs:3221, 3222, and 3223, respectively, and (ii) a VL comprising a VL CDR1, VL CDR2, and VL CDR3 having an amino acid sequence of SEQ ID NOs:3224, 3225, and 3226, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3227; and (ii) a VL comprising a VL CDR1, a VL CDR2, and a VL CDR3 having an amino acid sequence of a VL CDR1, a VL CDR2, and a VL CDR3, respectively, of SEQ ID NO:3228. In one aspect, provided herein is an antibody that binds TRDV2, comprising a VH having an amino acid sequence of SEQ ID NO:3227. In one aspect, provided herein is an antibody that binds TRDV2, comprising a VL having an amino acid sequence of SEQ ID NO:3228. In one aspect, provided herein is an antibody that binds TRDV2, comprising a VH having an amino acid sequence of SEQ ID NO:3227, and a VL having an amino acid sequence of SEQ ID NO:3228. In one aspect, provided herein is an antibody that binds TRDV2, comprising a heavy chain having an amino acid sequence of SEQ ID NO:3229. In one aspect, provided herein is an antibody that binds TRDV2, comprising a light chain having an amino acid sequence of SEQ ID NO:3230. In one aspect, provided herein is an antibody that binds TRDV2, comprising a heavy chain having an amino acid sequence of SEQ ID NO:3229, and a light chain having an amino acid sequence of SEQ ID NO:3230. In one aspect, provided herein is an antibody that binds TRDV2, comprising a VH having an amino acid sequence having at least 95% identity to an amino acid sequence of SEQ ID NO:3227. In one aspect, provided herein is an antibody that binds TRDV2, comprising a VL having an amino acid sequence having at least 95% identity to an amino acid sequence of SEQ ID NO:3228. In one aspect, provided herein is an antibody that binds TRDV2, comprising a VH having an amino acid sequence having at least 95% identity to an amino acid sequence of SEQ ID NO:3227, and a VL having an amino acid sequence having at least 95% identity to an amino acid sequence of SEQ ID NO:3228. In one aspect, provided herein is an antibody that binds TRDV2, comprising a heavy chain having an amino acid sequence having at least 95% identity to an amino acid sequence of SEQ ID NO:3229. In one aspect, provided herein is an antibody that binds TRDV2, comprising a light chain having an amino acid sequence having at least 95% identity to an amino acid sequence of SEQ ID NO:3230. In one aspect, provided herein is an antibody that binds TRDV2, comprising a heavy chain having an amino acid sequence having at least 95% identity to an amino acid sequence of SEQ ID NO:3229, and a light chain having an amino acid sequence having at least 95% identity to an amino acid sequence of SEQ ID NO:3230.

In one aspect, provided herein is an antibody that binds TRDV2, comprising: (i) a VH comprising a VH CDR1, a VH CDR2, and a VH CDR3 having an amino acid sequence of SEQ ID NOs:3231, 3232, and 3233, respectively, and (ii) a VL comprising a VL CDR1, VL CDR2, and VL CDR3 having an amino acid sequence of SEQ ID NOs:3234, 3235, and 3236, respectively. In one aspect, provided herein is an antibody that binds TRDV2, comprising: (i) a VH comprising a VH CDR1, a VH CDR2, and a VH CDR3 having an amino acid sequence of SEQ ID NOs:3237, 3238, and 3239, respectively, and (ii) a VL comprising a VL CDR1, VL CDR2, and VL CDR3 having an amino acid sequence of SEQ ID NOs:3240, 3241, and 3242, respectively. In one aspect, provided herein is an antibody that binds TRDV2, comprising: (i) a VH comprising a VH CDR1, a VH CDR2, and a VH CDR3 having an amino acid sequence of SEQ ID NOs:3243, 3244, and 3245, respectively, and (ii) a VL comprising a VL CDR1, VL CDR2, and VL CDR3 having an amino acid sequence of SEQ ID NOs:3246, 3247, and 3248, respectively. In one aspect, provided herein is an antibody that binds TRDV2, comprising: (i) a VH comprising a VH CDR1, a VH CDR2, and a VH CDR3 having an amino acid sequence of SEQ ID NOs:3249, 3250, and 3251, respectively, and (ii) a VL comprising a VL CDR1, VL CDR2, and VL CDR3 having an amino acid sequence of SEQ ID NOs:3252, 3253, and 3254, respectively. In one aspect, provided herein is an antibody that binds TRDV2, comprising: (i) a VH comprising a VH CDR1, a VH CDR2, and a VH CDR3 having an amino acid sequence of SEQ ID NOs:3255, 3256, and 3257, respectively, and (ii) a VL comprising a VL CDR1, VL CDR2, and VL CDR3 having an amino acid sequence of SEQ ID NOs:3258, 3259, and 3260, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3261; and (ii) a VL comprising a VL CDR1, a VL CDR2, and a VL CDR3 having an amino acid sequence of a VL CDR1, a VL CDR2, and a VL CDR3, respectively, of SEQ ID NO:3262. In one aspect, provided herein is an antibody that binds TRDV2, comprising a VH having an amino acid sequence of SEQ ID NO:3261. In one aspect, provided herein is an antibody that binds TRDV2, comprising a VL having an amino acid sequence of SEQ ID NO:3262. In one aspect, provided herein is an antibody that binds TRDV2, comprising a VH having an amino acid sequence of SEQ ID NO:3261, and a VL having an amino acid sequence of SEQ ID NO:3262. In one aspect, provided herein is an antibody that binds TRDV2, comprising a heavy chain having an amino acid sequence of SEQ ID NO:3263. In one aspect, provided herein is an antibody that binds TRDV2, comprising a light chain having an amino acid sequence of SEQ ID NO:3264. In one aspect, provided herein is an antibody that binds TRDV2, comprising a heavy chain having an amino acid sequence of SEQ ID NO:3263, and a light chain having an amino acid sequence of SEQ ID NO:3264. In one aspect, provided herein is an antibody that binds TRDV2, comprising a VH having an amino acid sequence having at least 95% identity to an amino acid sequence of SEQ ID NO:3261. In one aspect, provided herein is an antibody that binds TRDV2, comprising a VL having an amino acid sequence having at least 95% identity to an amino acid sequence of SEQ ID NO:3262. In one aspect, provided herein is an antibody that binds TRDV2, comprising a VH having an amino acid sequence having at least 95% identity to an amino acid sequence of SEQ ID NO:3261, and a VL having an amino acid sequence having at least 95% identity to an amino acid sequence of SEQ ID NO:3262. In one aspect, provided herein is an antibody that binds TRDV2, comprising a heavy chain having an amino acid sequence having at least 95% identity to an amino acid sequence of SEQ ID NO:3263. In one aspect, provided herein is an antibody that binds TRDV2, comprising a light chain having an amino acid sequence having at least 95% identity to an amino acid sequence of SEQ ID NO:3264. In one aspect, provided herein is an antibody that binds TRDV2, comprising a heavy chain having an amino acid sequence having at least 95% identity to an amino acid sequence of SEQ ID NO:3263, and a light chain having an amino acid sequence having at least 95% identity to an amino acid sequence of SEQ ID NO:3264.

In one aspect, provided herein is an antibody that binds TRDV2, comprising: (i) a VH comprising a VH CDR1, a VH CDR2, and a VH CDR3 having an amino acid sequence of SEQ ID NOs:3265, 3266, and 3267, respectively, and (ii) a VL comprising a VL CDR1, VL CDR2, and VL CDR3 having an amino acid sequence of SEQ ID NOs:3268, 3269, and 3270, respectively. In one aspect, provided herein is an antibody that binds TRDV2, comprising: (i) a VH comprising a VH CDR1, a VH CDR2, and a VH CDR3 having an amino acid sequence of SEQ ID NOs:3271, 3272, and 3273, respectively, and (ii) a VL comprising a VL CDR1, VL CDR2, and VL CDR3 having an amino acid sequence of SEQ ID NOs:3274, 3275, and 3276, respectively. In one aspect, provided herein is an antibody that binds TRDV2, comprising: (i) a VH comprising a VH CDR1, a VH CDR2, and a VH CDR3 having an amino acid sequence of SEQ ID NOs:3277, 3278, and 3279, respectively, and (ii) a VL comprising a VL CDR1, VL CDR2, and VL CDR3 having an amino acid sequence of SEQ ID NOs:3280, 3281, and 3282, respectively. In one aspect, provided herein is an antibody that binds TRDV2, comprising: (i) a VH comprising a VH CDR1, a VH CDR2, and a VH CDR3 having an amino acid sequence of SEQ ID NOs:3283, 3284, and 3285, respectively, and (ii) a VL comprising a VL CDR1, VL CDR2, and VL CDR3 having an amino acid sequence of SEQ ID NOs:3286, 3287, and 3288, respectively. In one aspect, provided herein is an antibody that binds TRDV2, comprising: (i) a VH comprising a VH CDR1, a VH CDR2, and a VH CDR3 having an amino acid sequence of SEQ ID NOs:3289, 3290, and 3291, respectively, and (ii) a VL comprising a VL CDR1, VL CDR2, and VL CDR3 having an amino acid sequence of SEQ ID NOs:3292, 3293, and 3294, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3295; and (ii) a VL comprising a VL CDR1, a VL CDR2, and a VL CDR3 having an amino acid sequence of a VL CDR1, a VL CDR2, and a VL CDR3, respectively, of SEQ ID NO:3296. In one aspect, provided herein is an antibody that binds TRDV2, comprising a VH having an amino acid sequence of SEQ ID NO:3295. In one aspect, provided herein is an antibody that binds TRDV2, comprising a VL having an amino acid sequence of SEQ ID NO:3296. In one aspect, provided herein is an antibody that binds TRDV2, comprising a VH having an amino acid sequence of SEQ ID NO:3295, and a VL having an amino acid sequence of SEQ ID NO:3296. In one aspect, provided herein is an antibody that binds TRDV2, comprising a heavy chain having an amino acid sequence of SEQ ID NO:3297. In one aspect, provided herein is an antibody that binds TRDV2, comprising a light chain having an amino acid sequence of SEQ ID NO:3298. In one aspect, provided herein is an antibody that binds TRDV2, comprising a heavy chain having an amino acid sequence of SEQ ID NO:3297, and a light chain having an amino acid sequence of SEQ ID NO:3298. In one aspect, provided herein is an antibody that binds TRDV2, comprising a VH having an amino acid sequence having at least 95% identity to an amino acid sequence of SEQ ID NO:3295. In one aspect, provided herein is an antibody that binds TRDV2, comprising a VL having an amino acid sequence having at least 95% identity to an amino acid sequence of SEQ ID NO:3296. In one aspect, provided herein is an antibody that binds TRDV2, comprising a VH having an amino acid sequence having at least 95% identity to an amino acid sequence of SEQ ID NO:3295, and a VL having an amino acid sequence having at least 95% identity to an amino acid sequence of SEQ ID NO:3296. In one aspect, provided herein is an antibody that binds TRDV2, comprising a heavy chain having an amino acid sequence having at least 95% identity to an amino acid sequence of SEQ ID NO:3297. In one aspect, provided herein is an antibody that binds TRDV2, comprising a light chain having an amino acid sequence having at least 95% identity to an amino acid sequence of SEQ ID NO:3298. In one aspect, provided herein is an antibody that binds TRDV2, comprising a heavy chain having an amino acid sequence having at least 95% identity to an amino acid sequence of SEQ ID NO:3297, and a light chain having an amino acid sequence having at least 95% identity to an amino acid sequence of SEQ ID NO:3298.

In one aspect, provided herein is an antibody that binds TRDV2, comprising: (i) a VH comprising a VH CDR1, a VH CDR2, and a VH CDR3 having an amino acid sequence of SEQ ID NOs:3299, 3300, and 3301, respectively, and (ii) a VL comprising a VL CDR1, VL CDR2, and VL CDR3 having an amino acid sequence of SEQ ID NOs:3302, 3303, and 3304, respectively. In one aspect, provided herein is an antibody that binds TRDV2, comprising: (i) a VH comprising a VH CDR1, a VH CDR2, and a VH CDR3 having an amino acid sequence of SEQ ID NOs:3305, 3306, and 3307, respectively, and (ii) a VL comprising a VL CDR1, VL CDR2, and VL CDR3 having an amino acid sequence of SEQ ID NOs:3308, 3309, and 3310, respectively. In one aspect, provided herein is an antibody that binds TRDV2, comprising: (i) a VH comprising a VH CDR1, a VH CDR2, and a VH CDR3 having an amino acid sequence of SEQ ID NOs:3311, 3312, and 3313, respectively, and (ii) a VL comprising a VL CDR1, VL CDR2, and VL CDR3 having an amino acid sequence of SEQ ID NOs:3314, 3315, and 3316, respectively. In one aspect, provided herein is an antibody that binds TRDV2, comprising: (i) a VH comprising a VH CDR1, a VH CDR2, and a VH CDR3 having an amino acid sequence of SEQ ID NOs:3317, 3318, and 3319, respectively, and (ii) a VL comprising a VL CDR1, VL CDR2, and VL CDR3 having an amino acid sequence of SEQ ID NOs:3320, 3321, and 3322, respectively. In one aspect, provided herein is an antibody that binds TRDV2, comprising: (i) a VH comprising a VH CDR1, a VH CDR2, and a VH CDR3 having an amino acid sequence of SEQ ID NOs:3323, 3324, and 3325, respectively, and (ii) a VL comprising a VL CDR1, VL CDR2, and VL CDR3 having an amino acid sequence of SEQ ID NOs:3326, 3327, and 3328, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3329; and (ii) a VL comprising a VL CDR1, a VL CDR2, and a VL CDR3 having an amino acid sequence of a VL CDR1, a VL CDR2, and a VL CDR3, respectively, of SEQ ID NO:3330. In one aspect, provided herein is an antibody that binds TRDV2, comprising a VH having an amino acid sequence of SEQ ID NO:3329. In one aspect, provided herein is an antibody that binds TRDV2, comprising a VL having an amino acid sequence of SEQ ID NO:3330. In one aspect, provided herein is an antibody that binds TRDV2, comprising a VH having an amino acid sequence of SEQ ID NO:3329, and a VL having an amino acid sequence of SEQ ID NO:3330. In one aspect, provided herein is an antibody that binds TRDV2, comprising a heavy chain having an amino acid sequence of SEQ ID NO:3331. In one aspect, provided herein is an antibody that binds TRDV2, comprising a light chain having an amino acid sequence of SEQ ID NO:3332. In one aspect, provided herein is an antibody that binds TRDV2, comprising a heavy chain having an amino acid sequence of SEQ ID NO:3331, and a light chain having an amino acid sequence of SEQ ID NO:3332. In one aspect, provided herein is an antibody that binds TRDV2, comprising a VH having an amino acid sequence having at least 95% identity to an amino acid sequence of SEQ ID NO:3329. In one aspect, provided herein is an antibody that binds TRDV2, comprising a VL having an amino acid sequence having at least 95% identity to an amino acid sequence of SEQ ID NO:3330. In one aspect, provided herein is an antibody that binds TRDV2, comprising a VH having an amino acid sequence having at least 95% identity to an amino acid sequence of SEQ ID NO:3329, and a VL having an amino acid sequence having at least 95% identity to an amino acid sequence of SEQ ID NO:3330. In one aspect, provided herein is an antibody that binds TRDV2, comprising a heavy chain having an amino acid sequence having at least 95% identity to an amino acid sequence of SEQ ID NO:3331. In one aspect, provided herein is an antibody that binds TRDV2, comprising a light chain having an amino acid sequence having at least 95% identity to an amino acid sequence of SEQ ID NO:3332. In one aspect, provided herein is an antibody that binds TRDV2, comprising a heavy chain having an amino acid sequence having at least 95% identity to an amino acid sequence of SEQ ID NO:3331, and a light chain having an amino acid sequence having at least 95% identity to an amino acid sequence of SEQ ID NO:3332.

In one aspect, provided herein is an antibody that binds TRDV2, comprising: (i) a VH comprising a VH CDR1, a VH CDR2, and a VH CDR3 having an amino acid sequence of SEQ ID NOs:3333, 3334, and 3335, respectively, and (ii) a VL comprising a VL CDR1, VL CDR2, and VL CDR3 having an amino acid sequence of SEQ ID NOs:3336, 3337, and 3338, respectively. In one aspect, provided herein is an antibody that binds TRDV2, comprising: (i) a VH comprising a VH CDR1, a VH CDR2, and a VH CDR3 having an amino acid sequence of SEQ ID NOs:3339, 3340, and 3341, respectively, and (ii) a VL comprising a VL CDR1, VL CDR2, and VL CDR3 having an amino acid sequence of SEQ ID NOs:3342, 3343, and 3344, respectively. In one aspect, provided herein is an antibody that binds TRDV2, comprising: (i) a VH comprising a VH CDR1, a VH CDR2, and a VH CDR3 having an amino acid sequence of SEQ ID NOs:3345, 3346, and 3347, respectively, and (ii) a VL comprising a VL CDR1, VL CDR2, and VL CDR3 having an amino acid sequence of SEQ ID NOs:3348, 3349, and 3350, respectively. In one aspect, provided herein is an antibody that binds TRDV2, comprising: (i) a VH comprising a VH CDR1, a VH CDR2, and a VH CDR3 having an amino acid sequence of SEQ ID NOs:3351, 3352, and 3353, respectively, and (ii) a VL comprising a VL CDR1, VL CDR2, and VL CDR3 having an amino acid sequence of SEQ ID NOs:3354, 3355, and 3356, respectively. In one aspect, provided herein is an antibody that binds TRDV2, comprising: (i) a VH comprising a VH CDR1, a VH CDR2, and a VH CDR3 having an amino acid sequence of SEQ ID NOs:3357, 3358, and 3359, respectively, and (ii) a VL comprising a VL CDR1, VL CDR2, and VL CDR3 having an amino acid sequence of SEQ ID NOs:3360, 3361, and 3362, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3363; and (ii) a VL comprising a VL CDR1, a VL CDR2, and a VL CDR3 having an amino acid sequence of a VL CDR1, a VL CDR2, and a VL CDR3, respectively, of SEQ ID NO:3364. In one aspect, provided herein is an antibody that binds TRDV2, comprising a VH having an amino acid sequence of SEQ ID NO:3363. In one aspect, provided herein is an antibody that binds TRDV2, comprising a VL having an amino acid sequence of SEQ ID NO:3364. In one aspect, provided herein is an antibody that binds TRDV2, comprising a VH having an amino acid sequence of SEQ ID NO:3363, and a VL having an amino acid sequence of SEQ ID NO:3364. In one aspect, provided herein is an antibody that binds TRDV2, comprising a heavy chain having an amino acid sequence of SEQ ID NO:3365. In one aspect, provided herein is an antibody that binds TRDV2, comprising a light chain having an amino acid sequence of SEQ ID NO:3366. In one aspect, provided herein is an antibody that binds TRDV2, comprising a heavy chain having an amino acid sequence of SEQ ID NO:3365, and a light chain having an amino acid sequence of SEQ ID NO:3366. In one aspect, provided herein is an antibody that binds TRDV2, comprising a VH having an amino acid sequence having at least 95% identity to an amino acid sequence of SEQ ID NO:3363. In one aspect, provided herein is an antibody that binds TRDV2, comprising a VL having an amino acid sequence having at least 95% identity to an amino acid sequence of SEQ ID NO:3364. In one aspect, provided herein is an antibody that binds TRDV2, comprising a VH having an amino acid sequence having at least 95% identity to an amino acid sequence of SEQ ID NO:3363, and a VL having an amino acid sequence having at least 95% identity to an amino acid sequence of SEQ ID NO:3364. In one aspect, provided herein is an antibody that binds TRDV2, comprising a heavy chain having an amino acid sequence having at least 95% identity to an amino acid sequence of SEQ ID NO:3365. In one aspect, provided herein is an antibody that binds TRDV2, comprising a light chain having an amino acid sequence having at least 95% identity to an amino acid sequence of SEQ ID NO:3366. In one aspect, provided herein is an antibody that binds TRDV2, comprising a heavy chain having an amino acid sequence having at least 95% identity to an amino acid sequence of SEQ ID NO:3365, and a light chain having an amino acid sequence having at least 95% identity to an amino acid sequence of SEQ ID NO:3366.

In one aspect, provided herein is an antibody that binds TRDV2, comprising: (i) a VH comprising a VH CDR1, a VH CDR2, and a VH CDR3 having an amino acid sequence of SEQ ID NOs:3367, 3368, and 3369, respectively, and (ii) a VL comprising a VL CDR1, VL CDR2, and VL CDR3 having an amino acid sequence of SEQ ID NOs:3370, 3371, and 3372, respectively. In one aspect, provided herein is an antibody that binds TRDV2, comprising: (i) a VH comprising a VH CDR1, a VH CDR2, and a VH CDR3 having an amino acid sequence of SEQ ID NOs:3373, 3374, and 3375, respectively, and (ii) a VL comprising a VL CDR1, VL CDR2, and VL CDR3 having an amino acid sequence of SEQ ID NOs:3376, 3377, and 3378, respectively. In one aspect, provided herein is an antibody that binds TRDV2, comprising: (i) a VH comprising a VH CDR1, a VH CDR2, and a VH CDR3 having an amino acid sequence of SEQ ID NOs:3379, 3380, and 3381, respectively, and (ii) a VL comprising a VL CDR1, VL CDR2, and VL CDR3 having an amino acid sequence of SEQ ID NOs:3382, 3383, and 3384, respectively. In one aspect, provided herein is an antibody that binds TRDV2, comprising: (i) a VH comprising a VH CDR1, a VH CDR2, and a VH CDR3 having an amino acid sequence of SEQ ID NOs:3385, 3386, and 3387, respectively, and (ii) a VL comprising a VL CDR1, VL CDR2, and VL CDR3 having an amino acid sequence of SEQ ID NOs:3388, 3389, and 3390, respectively. In one aspect, provided herein is an antibody that binds TRDV2, comprising: (i) a VH comprising a VH CDR1, a VH CDR2, and a VH CDR3 having an amino acid sequence of SEQ ID NOs:3391, 3392, and 3393, respectively, and (ii) a VL comprising a VL CDR1, VL CDR2, and VL CDR3 having an amino acid sequence of SEQ ID NOs:3394, 3395, and 3396, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3397; and (ii) a VL comprising a VL CDR1, a VL CDR2, and a VL CDR3 having an amino acid sequence of a VL CDR1, a VL CDR2, and a VL CDR3, respectively, of SEQ ID NO:3398. In one aspect, provided herein is an antibody that binds TRDV2, comprising a VH having an amino acid sequence of SEQ ID NO:3397. In one aspect, provided herein is an antibody that binds TRDV2, comprising a VL having an amino acid sequence of SEQ ID NO:3398. In one aspect, provided herein is an antibody that binds TRDV2, comprising a VH having an amino acid sequence of SEQ ID NO:3397, and a VL having an amino acid sequence of SEQ ID NO:3398. In one aspect, provided herein is an antibody that binds TRDV2, comprising a heavy chain having an amino acid sequence of SEQ ID NO:3399. In one aspect, provided herein is an antibody that binds TRDV2, comprising a light chain having an amino acid sequence of SEQ ID NO:3400. In one aspect, provided herein is an antibody that binds TRDV2, comprising a heavy chain having an amino acid sequence of SEQ ID NO:3399, and a light chain having an amino acid sequence of SEQ ID NO:3400. In one aspect, provided herein is an antibody that binds TRDV2, comprising a VH having an amino acid sequence having at least 95% identity to an amino acid sequence of SEQ ID NO:3397. In one aspect, provided herein is an antibody that binds TRDV2, comprising a VL having an amino acid sequence having at least 95% identity to an amino acid sequence of SEQ ID NO:3398. In one aspect, provided herein is an antibody that binds TRDV2, comprising a VH having an amino acid sequence having at least 95% identity to an amino acid sequence of SEQ ID NO:3397, and a VL having an amino acid sequence having at least 95% identity to an amino acid sequence of SEQ ID NO:3398. In one aspect, provided herein is an antibody that binds TRDV2, comprising a heavy chain having an amino acid sequence having at least 95% identity to an amino acid sequence of SEQ ID NO:3399. In one aspect, provided herein is an antibody that binds TRDV2, comprising a light chain having an amino acid sequence having at least 95% identity to an amino acid sequence of SEQ ID NO:3400. In one aspect, provided herein is an antibody that binds TRDV2, comprising a heavy chain having an amino acid sequence having at least 95% identity to an amino acid sequence of SEQ ID NO:3399, and a light chain having an amino acid sequence having at least 95% identity to an amino acid sequence of SEQ ID NO:3400.

In one aspect, provided herein is an antibody that binds TRDV2, comprising: (i) a VH comprising a VH CDR1, a VH CDR2, and a VH CDR3 having an amino acid sequence of SEQ ID NOs:3401, 3402, and 3403, respectively, and (ii) a VL comprising a VL CDR1, VL CDR2, and VL CDR3 having an amino acid sequence of SEQ ID NOs:3404, 3405, and 3406, respectively. In one aspect, provided herein is an antibody that binds TRDV2, comprising: (i) a VH comprising a VH CDR1, a VH CDR2, and a VH CDR3 having an amino acid sequence of SEQ ID NOs:3407, 3408, and 3409, respectively, and (ii) a VL comprising a VL CDR1, VL CDR2, and VL CDR3 having an amino acid sequence of SEQ ID NOs:3410, 3411, and 3412, respectively. In one aspect, provided herein is an antibody that binds TRDV2, comprising: (i) a VH comprising a VH CDR1, a VH CDR2, and a VH CDR3 having an amino acid sequence of SEQ ID NOs:3413, 3414, and 3415, respectively, and (ii) a VL comprising a VL CDR1, VL CDR2, and VL CDR3 having an amino acid sequence of SEQ ID NOs:3416, 3417, and 3418, respectively. In one aspect, provided herein is an antibody that binds TRDV2, comprising: (i) a VH comprising a VH CDR1, a VH CDR2, and a VH CDR3 having an amino acid sequence of SEQ ID NOs:3419, 3420, and 3421, respectively, and (ii) a VL comprising a VL CDR1, VL CDR2, and VL CDR3 having an amino acid sequence of SEQ ID NOs:3422, 3423, and 3424, respectively. In one aspect, provided herein is an antibody that binds TRDV2, comprising: (i) a VH comprising a VH CDR1, a VH CDR2, and a VH CDR3 having an amino acid sequence of SEQ ID NOs:3425, 3426, and 3427, respectively, and (ii) a VL comprising a VL CDR1, VL CDR2, and VL CDR3 having an amino acid sequence of SEQ ID NOs:3428, 3429, and 3430, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3431; and (ii) a VL comprising a VL CDR1, a VL CDR2, and a VL CDR3 having an amino acid sequence of a VL CDR1, a VL CDR2, and a VL CDR3, respectively, of SEQ ID NO:3432. In one aspect, provided herein is an antibody that binds TRDV2, comprising a VH having an amino acid sequence of SEQ ID NO:3431. In one aspect, provided herein is an antibody that binds TRDV2, comprising a VL having an amino acid sequence of SEQ ID NO:3432. In one aspect, provided herein is an antibody that binds TRDV2, comprising a VH having an amino acid sequence of SEQ ID NO:3431, and a VL having an amino acid sequence of SEQ ID NO:3432. In one aspect, provided herein is an antibody that binds TRDV2, comprising a heavy chain having an amino acid sequence of SEQ ID NO:3433. In one aspect, provided herein is an antibody that binds TRDV2, comprising a light chain having an amino acid sequence of SEQ ID NO:3434. In one aspect, provided herein is an antibody that binds TRDV2, comprising a heavy chain having an amino acid sequence of SEQ ID NO:3433, and a light chain having an amino acid sequence of SEQ ID NO:3434. In one aspect, provided herein is an antibody that binds TRDV2, comprising a VH having an amino acid sequence having at least 95% identity to an amino acid sequence of SEQ ID NO:3431. In one aspect, provided herein is an antibody that binds TRDV2, comprising a VL having an amino acid sequence having at least 95% identity to an amino acid sequence of SEQ ID NO:3432. In one aspect, provided herein is an antibody that binds TRDV2, comprising a VH having an amino acid sequence having at least 95% identity to an amino acid sequence of SEQ ID NO:3431, and a VL having an amino acid sequence having at least 95% identity to an amino acid sequence of SEQ ID NO:3432. In one aspect, provided herein is an antibody that binds TRDV2, comprising a heavy chain having an amino acid sequence having at least 95% identity to an amino acid sequence of SEQ ID NO:3433. In one aspect, provided herein is an antibody that binds TRDV2, comprising a light chain having an amino acid sequence having at least 95% identity to an amino acid sequence of SEQ ID NO:3434. In one aspect, provided herein is an antibody that binds TRDV2, comprising a heavy chain having an amino acid sequence having at least 95% identity to an amino acid sequence of SEQ ID NO:3433, and a light chain having an amino acid sequence having at least 95% identity to an amino acid sequence of SEQ ID NO:3434.

In one aspect, provided herein is an antibody that binds TRDV2, comprising: (i) a VH comprising a VH CDR1, a VH CDR2, and a VH CDR3 having an amino acid sequence of SEQ ID NOs:3435, 3436, and 3437, respectively, and (ii) a VL comprising a VL CDR1, VL CDR2, and VL CDR3 having an amino acid sequence of SEQ ID NOs:3438, 3439, and 3440, respectively. In one aspect, provided herein is an antibody that binds TRDV2, comprising: (i) a VH comprising a VH CDR1, a VH CDR2, and a VH CDR3 having an amino acid sequence of SEQ ID NOs:3441, 3442, and 3443, respectively, and (ii) a VL comprising a VL CDR1, VL CDR2, and VL CDR3 having an amino acid sequence of SEQ ID NOs:3444, 3445, and 3446, respectively. In one aspect, provided herein is an antibody that binds TRDV2, comprising: (i) a VH comprising a VH CDR1, a VH CDR2, and a VH CDR3 having an amino acid sequence of SEQ ID NOs:3447, 3448, and 3449, respectively, and (ii) a VL comprising a VL CDR1, VL CDR2, and VL CDR3 having an amino acid sequence of SEQ ID NOs:3450, 3451, and 3452, respectively. In one aspect, provided herein is an antibody that binds TRDV2, comprising: (i) a VH comprising a VH CDR1, a VH CDR2, and a VH CDR3 having an amino acid sequence of SEQ ID NOs:3453, 3454, and 3455, respectively, and (ii) a VL comprising a VL CDR1, VL CDR2, and VL CDR3 having an amino acid sequence of SEQ ID NOs:3456, 3457, and 3458, respectively. In one aspect, provided herein is an antibody that binds TRDV2, comprising: (i) a VH comprising a VH CDR1, a VH CDR2, and a VH CDR3 having an amino acid sequence of SEQ ID NOs:3459, 3460, and 3461, respectively, and (ii) a VL comprising a VL CDR1, VL CDR2, and VL CDR3 having an amino acid sequence of SEQ ID NOs:3462, 3463, and 3464, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3465; and (ii) a VL comprising a VL CDR1, a VL CDR2, and a VL CDR3 having an amino acid sequence of a VL CDR1, a VL CDR2, and a VL CDR3, respectively, of SEQ ID NO:3466. In one aspect, provided herein is an antibody that binds TRDV2, comprising a VH having an amino acid sequence of SEQ ID NO:3465. In one aspect, provided herein is an antibody that binds TRDV2, comprising a VL having an amino acid sequence of SEQ ID NO:3466. In one aspect, provided herein is an antibody that binds TRDV2, comprising a VH having an amino acid sequence of SEQ ID NO:3465, and a VL having an amino acid sequence of SEQ ID NO:3466. In one aspect, provided herein is an antibody that binds TRDV2, comprising a heavy chain having an amino acid sequence of SEQ ID NO:3467. In one aspect, provided herein is an antibody that binds TRDV2, comprising a light chain having an amino acid sequence of SEQ ID NO:3468. In one aspect, provided herein is an antibody that binds TRDV2, comprising a heavy chain having an amino acid sequence of SEQ ID NO:3467, and a light chain having an amino acid sequence of SEQ ID NO:3468. In one aspect, provided herein is an antibody that binds TRDV2, comprising a VH having an amino acid sequence having at least 95% identity to an amino acid sequence of SEQ ID NO:3465. In one aspect, provided herein is an antibody that binds TRDV2, comprising a VL having an amino acid sequence having at least 95% identity to an amino acid sequence of SEQ ID NO:3466. In one aspect, provided herein is an antibody that binds TRDV2, comprising a VH having an amino acid sequence having at least 95% identity to an amino acid sequence of SEQ ID NO:3465, and a VL having an amino acid sequence having at least 95% identity to an amino acid sequence of SEQ ID NO:3466. In one aspect, provided herein is an antibody that binds TRDV2, comprising a heavy chain having an amino acid sequence having at least 95% identity to an amino acid sequence of SEQ ID NO:3467. In one aspect, provided herein is an antibody that binds TRDV2, comprising a light chain having an amino acid sequence having at least 95% identity to an amino acid sequence of SEQ ID NO:3468. In one aspect, provided herein is an antibody that binds TRDV2, comprising a heavy chain having an amino acid sequence having at least 95% identity to an amino acid sequence of SEQ ID NO:3467, and a light chain having an amino acid sequence having at least 95% identity to an amino acid sequence of SEQ ID NO:3468.

In one aspect, provided herein is an antibody that binds TRDV2, comprising: (i) a VH comprising a VH CDR1, a VH CDR2, and a VH CDR3 having an amino acid sequence of SEQ ID NOs:3469, 3470, and 3471, respectively, and (ii) a VL comprising a VL CDR1, VL CDR2, and VL CDR3 having an amino acid sequence of SEQ ID NOs:3472, 3473, and 3474, respectively. In one aspect, provided herein is an antibody that binds TRDV2, comprising: (i) a VH comprising a VH CDR1, a VH CDR2, and a VH CDR3 having an amino acid sequence of SEQ ID NOs:3475, 3476, and 3477, respectively, and (ii) a VL comprising a VL CDR1, VL CDR2, and VL CDR3 having an amino acid sequence of SEQ ID NOs:3478, 3479, and 3480, respectively. In one aspect, provided herein is an antibody that binds TRDV2, comprising: (i) a VH comprising a VH CDR1, a VH CDR2, and a VH CDR3 having an amino acid sequence of SEQ ID NOs:3481, 3482, and 3483, respectively, and (ii) a VL comprising a VL CDR1, VL CDR2, and VL CDR3 having an amino acid sequence of SEQ ID NOs:3484, 3485, and 3486, respectively. In one aspect, provided herein is an antibody that binds TRDV2, comprising: (i) a VH comprising a VH CDR1, a VH CDR2, and a VH CDR3 having an amino acid sequence of SEQ ID NOs:3487, 3488, and 3489, respectively, and (ii) a VL comprising a VL CDR1, VL CDR2, and VL CDR3 having an amino acid sequence of SEQ ID NOs:3490, 3491, and 3492, respectively. In one aspect, provided herein is an antibody that binds TRDV2, comprising: (i) a VH comprising a VH CDR1, a VH CDR2, and a VH CDR3 having an amino acid sequence of SEQ ID NOs:3493, 3494, and 3495, respectively, and (ii) a VL comprising a VL CDR1, VL CDR2, and VL CDR3 having an amino acid sequence of SEQ ID NOs:3496, 3497, and 3498, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3499; and (ii) a VL comprising a VL CDR1, a VL CDR2, and a VL CDR3 having an amino acid sequence of a VL CDR1, a VL CDR2, and a VL CDR3, respectively, of SEQ ID NO:3500. In one aspect, provided herein is an antibody that binds TRDV2, comprising a VH having an amino acid sequence of SEQ ID NO:3499. In one aspect, provided herein is an antibody that binds TRDV2, comprising a VL having an amino acid sequence of SEQ ID NO:3500. In one aspect, provided herein is an antibody that binds TRDV2, comprising a VH having an amino acid sequence of SEQ ID NO:3499, and a VL having an amino acid sequence of SEQ ID NO:3500. In one aspect, provided herein is an antibody that binds TRDV2, comprising a heavy chain having an amino acid sequence of SEQ ID NO:3501. In one aspect, provided herein is an antibody that binds TRDV2, comprising a light chain having an amino acid sequence of SEQ ID NO:3502. In one aspect, provided herein is an antibody that binds TRDV2, comprising a heavy chain having an amino acid sequence of SEQ ID NO:3501, and a light chain having an amino acid sequence of SEQ ID NO:3502. In one aspect, provided herein is an antibody that binds TRDV2, comprising a VH having an amino acid sequence having at least 95% identity to an amino acid sequence of SEQ ID NO:3499. In one aspect, provided herein is an antibody that binds TRDV2, comprising a VL having an amino acid sequence having at least 95% identity to an amino acid sequence of SEQ ID NO:3500. In one aspect, provided herein is an antibody that binds TRDV2, comprising a VH having an amino acid sequence having at least 95% identity to an amino acid sequence of SEQ ID NO:3499, and a VL having an amino acid sequence having at least 95% identity to an amino acid sequence of SEQ ID NO:3500. In one aspect, provided herein is an antibody that binds TRDV2, comprising a heavy chain having an amino acid sequence having at least 95% identity to an amino acid sequence of SEQ ID NO:3501. In one aspect, provided herein is an antibody that binds TRDV2, comprising a light chain having an amino acid sequence having at least 95% identity to an amino acid sequence of SEQ ID NO:3502. In one aspect, provided herein is an antibody that binds TRDV2, comprising a heavy chain having an amino acid sequence having at least 95% identity to an amino acid sequence of SEQ ID NO:3501, and a light chain having an amino acid sequence having at least 95% identity to an amino acid sequence of SEQ ID NO:3502.

In one aspect, provided herein is an antibody that binds TRDV2, comprising: (i) a VH comprising a VH CDR1, a VH CDR2, and a VH CDR3 having an amino acid sequence of SEQ ID NOs:3503, 3504, and 3505, respectively, and (ii) a VL comprising a VL CDR1, VL CDR2, and VL CDR3 having an amino acid sequence of SEQ ID NOs:3506, 3507, and 3508, respectively. In one aspect, provided herein is an antibody that binds TRDV2, comprising: (i) a VH comprising a VH CDR1, a VH CDR2, and a VH CDR3 having an amino acid sequence of SEQ ID NOs:3509, 3510, and 3511, respectively, and (ii) a VL comprising a VL CDR1, VL CDR2, and VL CDR3 having an amino acid sequence of SEQ ID NOs:3512, 3513, and 3514, respectively. In one aspect, provided herein is an antibody that binds TRDV2, comprising: (i) a VH comprising a VH CDR1, a VH CDR2, and a VH CDR3 having an amino acid sequence of SEQ ID NOs:3515, 3516, and 3517, respectively, and (ii) a VL comprising a VL CDR1, VL CDR2, and VL CDR3 having an amino acid sequence of SEQ ID NOs:3518, 3519, and 3520, respectively. In one aspect, provided herein is an antibody that binds TRDV2, comprising: (i) a VH comprising a VH CDR1, a VH CDR2, and a VH CDR3 having an amino acid sequence of SEQ ID NOs:3521, 3522, and 3523, respectively, and (ii) a VL comprising a VL CDR1, VL CDR2, and VL CDR3 having an amino acid sequence of SEQ ID NOs:3524, 3525, and 3526, respectively. In one aspect, provided herein is an antibody that binds TRDV2, comprising: (i) a VH comprising a VH CDR1, a VH CDR2, and a VH CDR3 having an amino acid sequence of SEQ ID NOs:3527, 3528, and 3529, respectively, and (ii) a VL comprising a VL CDR1, VL CDR2, and VL CDR3 having an amino acid sequence of SEQ ID NOs:3530, 3531, and 3532, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3533; and (ii) a VL comprising a VL CDR1, a VL CDR2, and a VL CDR3 having an amino acid sequence of a VL CDR1, a VL CDR2, and a VL CDR3, respectively, of SEQ ID NO:3534. In one aspect, provided herein is an antibody that binds TRDV2, comprising a VH having an amino acid sequence of SEQ ID NO:3533. In one aspect, provided herein is an antibody that binds TRDV2, comprising a VL having an amino acid sequence of SEQ ID NO:3534. In one aspect, provided herein is an antibody that binds TRDV2, comprising a VH having an amino acid sequence of SEQ ID NO:3533, and a VL having an amino acid sequence of SEQ ID NO:3534. In one aspect, provided herein is an antibody that binds TRDV2, comprising a heavy chain having an amino acid sequence of SEQ ID NO:3535. In one aspect, provided herein is an antibody that binds TRDV2, comprising a light chain having an amino acid sequence of SEQ ID NO:3536. In one aspect, provided herein is an antibody that binds TRDV2, comprising a heavy chain having an amino acid sequence of SEQ ID NO:3535, and a light chain having an amino acid sequence of SEQ ID NO:3536. In one aspect, provided herein is an antibody that binds TRDV2, comprising a VH having an amino acid sequence having at least 95% identity to an amino acid sequence of SEQ ID NO:3533. In one aspect, provided herein is an antibody that binds TRDV2, comprising a VL having an amino acid sequence having at least 95% identity to an amino acid sequence of SEQ ID NO:3534. In one aspect, provided herein is an antibody that binds TRDV2, comprising a VH having an amino acid sequence having at least 95% identity to an amino acid sequence of SEQ ID NO:3533, and a VL having an amino acid sequence having at least 95% identity to an amino acid sequence of SEQ ID NO:3534. In one aspect, provided herein is an antibody that binds TRDV2, comprising a heavy chain having an amino acid sequence having at least 95% identity to an amino acid sequence of SEQ ID NO:3535. In one aspect, provided herein is an antibody that binds TRDV2, comprising a light chain having an amino acid sequence having at least 95% identity to an amino acid sequence of SEQ ID NO:3536. In one aspect, provided herein is an antibody that binds TRDV2, comprising a heavy chain having an amino acid sequence having at least 95% identity to an amino acid sequence of SEQ ID NO:3535, and a light chain having an amino acid sequence having at least 95% identity to an amino acid sequence of SEQ ID NO:3536.

In one aspect, provided herein is an antibody that binds TRDV2, comprising: (i) a VH comprising a VH CDR1, a VH CDR2, and a VH CDR3 having an amino acid sequence of SEQ ID NOs:3537, 3538, and 3539, respectively, and (ii) a VL comprising a VL CDR1, VL CDR2, and VL CDR3 having an amino acid sequence of SEQ ID NOs:3540, 3541, and 3542, respectively. In one aspect, provided herein is an antibody that binds TRDV2, comprising: (i) a VH comprising a VH CDR1, a VH CDR2, and a VH CDR3 having an amino acid sequence of SEQ ID NOs:3543, 3544, and 3545, respectively, and (ii) a VL comprising a VL CDR1, VL CDR2, and VL CDR3 having an amino acid sequence of SEQ ID NOs:3546, 3547, and 3548, respectively. In one aspect, provided herein is an antibody that binds TRDV2, comprising: (i) a VH comprising a VH CDR1, a VH CDR2, and a VH CDR3 having an amino acid sequence of SEQ ID NOs:3549, 3550, and 3551, respectively, and (ii) a VL comprising a VL CDR1, VL CDR2, and VL CDR3 having an amino acid sequence of SEQ ID NOs:3552, 3553, and 3554, respectively. In one aspect, provided herein is an antibody that binds TRDV2, comprising: (i) a VH comprising a VH CDR1, a VH CDR2, and a VH CDR3 having an amino acid sequence of SEQ ID NOs:3555, 3556, and 3557, respectively, and (ii) a VL comprising a VL CDR1, VL CDR2, and VL CDR3 having an amino acid sequence of SEQ ID NOs:3558, 3559, and 3560, respectively. In one aspect, provided herein is an antibody that binds TRDV2, comprising: (i) a VH comprising a VH CDR1, a VH CDR2, and a VH CDR3 having an amino acid sequence of SEQ ID NOs:3561, 3562, and 3563, respectively, and (ii) a VL comprising a VL CDR1, VL CDR2, and VL CDR3 having an amino acid sequence of SEQ ID NOs:3564, 3565, and 3566, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3567; and (ii) a VL comprising a VL CDR1, a VL CDR2, and a VL CDR3 having an amino acid sequence of a VL CDR1, a VL CDR2, and a VL CDR3, respectively, of SEQ ID NO:3568. In one aspect, provided herein is an antibody that binds TRDV2, comprising a VH having an amino acid sequence of SEQ ID NO:3567. In one aspect, provided herein is an antibody that binds TRDV2, comprising a VL having an amino acid sequence of SEQ ID NO:3568. In one aspect, provided herein is an antibody that binds TRDV2, comprising a VH having an amino acid sequence of SEQ ID NO:3567, and a VL having an amino acid sequence of SEQ ID NO:3568. In one aspect, provided herein is an antibody that binds TRDV2, comprising a heavy chain having an amino acid sequence of SEQ ID NO:3569. In one aspect, provided herein is an antibody that binds TRDV2, comprising a light chain having an amino acid sequence of SEQ ID NO:3570. In one aspect, provided herein is an antibody that binds TRDV2, comprising a heavy chain having an amino acid sequence of SEQ ID NO:3569, and a light chain having an amino acid sequence of SEQ ID NO:3570. In one aspect, provided herein is an antibody that binds TRDV2, comprising a VH having an amino acid sequence having at least 95% identity to an amino acid sequence of SEQ ID NO:3567. In one aspect, provided herein is an antibody that binds TRDV2, comprising a VL having an amino acid sequence having at least 95% identity to an amino acid sequence of SEQ ID NO:3568. In one aspect, provided herein is an antibody that binds TRDV2, comprising a VH having an amino acid sequence having at least 95% identity to an amino acid sequence of SEQ ID NO:3567, and a VL having an amino acid sequence having at least 95% identity to an amino acid sequence of SEQ ID NO:3568. In one aspect, provided herein is an antibody that binds TRDV2, comprising a heavy chain having an amino acid sequence having at least 95% identity to an amino acid sequence of SEQ ID NO:3569. In one aspect, provided herein is an antibody that binds TRDV2, comprising a light chain having an amino acid sequence having at least 95% identity to an amino acid sequence of SEQ ID NO:3570. In one aspect, provided herein is an antibody that binds TRDV2, comprising a heavy chain having an amino acid sequence having at least 95% identity to an amino acid sequence of SEQ ID NO:3569, and a light chain having an amino acid sequence having at least 95% identity to an amino acid sequence of SEQ ID NO:3570.

In one aspect, provided herein is an antibody that binds TRDV2, comprising: (i) a VH comprising a VH CDR1, a VH CDR2, and a VH CDR3 having an amino acid sequence of SEQ ID NOs:3571, 3572, and 3573, respectively, and (ii) a VL comprising a VL CDR1, VL CDR2, and VL CDR3 having an amino acid sequence of SEQ ID NOs:3574, 3575, and 3576, respectively. In one aspect, provided herein is an antibody that binds TRDV2, comprising: (i) a VH comprising a VH CDR1, a VH CDR2, and a VH CDR3 having an amino acid sequence of SEQ ID NOs:3577, 3578, and 3579, respectively, and (ii) a VL comprising a VL CDR1, VL CDR2, and VL CDR3 having an amino acid sequence of SEQ ID NOs:3580, 3581, and 3582, respectively. In one aspect, provided herein is an antibody that binds TRDV2, comprising: (i) a VH comprising a VH CDR1, a VH CDR2, and a VH CDR3 having an amino acid sequence of SEQ ID NOs:3583, 3584, and 3585, respectively, and (ii) a VL comprising a VL CDR1, VL CDR2, and VL CDR3 having an amino acid sequence of SEQ ID NOs:3586, 3587, and 3588, respectively. In one aspect, provided herein is an antibody that binds TRDV2, comprising: (i) a VH comprising a VH CDR1, a VH CDR2, and a VH CDR3 having an amino acid sequence of SEQ ID NOs:3589, 3590, and 3591, respectively, and (ii) a VL comprising a VL CDR1, VL CDR2, and VL CDR3 having an amino acid sequence of SEQ ID NOs:3592, 3593, and 3594, respectively. In one aspect, provided herein is an antibody that binds TRDV2, comprising: (i) a VH comprising a VH CDR1, a VH CDR2, and a VH CDR3 having an amino acid sequence of SEQ ID NOs:3595, 3596, and 3597, respectively, and (ii) a VL comprising a VL CDR1, VL CDR2, and VL CDR3 having an amino acid sequence of SEQ ID NOs:3598, 3599, and 3600, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3601; and (ii) a VL comprising a VL CDR1, a VL CDR2, and a VL CDR3 having an amino acid sequence of a VL CDR1, a VL CDR2, and a VL CDR3, respectively, of SEQ ID NO:3602. In one aspect, provided herein is an antibody that binds TRDV2, comprising a VH having an amino acid sequence of SEQ ID NO:3601. In one aspect, provided herein is an antibody that binds TRDV2, comprising a VL having an amino acid sequence of SEQ ID NO:3602. In one aspect, provided herein is an antibody that binds TRDV2, comprising a VH having an amino acid sequence of SEQ ID NO:3601, and a VL having an amino acid sequence of SEQ ID NO:3602. In one aspect, provided herein is an antibody that binds TRDV2, comprising a heavy chain having an amino acid sequence of SEQ ID NO:3603. In one aspect, provided herein is an antibody that binds TRDV2, comprising a light chain having an amino acid sequence of SEQ ID NO:3604. In one aspect, provided herein is an antibody that binds TRDV2, comprising a heavy chain having an amino acid sequence of SEQ ID NO:3603, and a light chain having an amino acid sequence of SEQ ID NO:3604. In one aspect, provided herein is an antibody that binds TRDV2, comprising a VH having an amino acid sequence having at least 95% identity to an amino acid sequence of SEQ ID NO:3601. In one aspect, provided herein is an antibody that binds TRDV2, comprising a VL having an amino acid sequence having at least 95% identity to an amino acid sequence of SEQ ID NO:3602. In one aspect, provided herein is an antibody that binds TRDV2, comprising a VH having an amino acid sequence having at least 95% identity to an amino acid sequence of SEQ ID NO:3601, and a VL having an amino acid sequence having at least 95% identity to an amino acid sequence of SEQ ID NO:3602. In one aspect, provided herein is an antibody that binds TRDV2, comprising a heavy chain having an amino acid sequence having at least 95% identity to an amino acid sequence of SEQ ID NO:3603. In one aspect, provided herein is an antibody that binds TRDV2, comprising a light chain having an amino acid sequence having at least 95% identity to an amino acid sequence of SEQ ID NO:3604. In one aspect, provided herein is an antibody that binds TRDV2, comprising a heavy chain having an amino acid sequence having at least 95% identity to an amino acid sequence of SEQ ID NO:3603, and a light chain having an amino acid sequence having at least 95% identity to an amino acid sequence of SEQ ID NO:3604.

In one aspect, provided herein is an antibody that binds TRDV2, comprising: (i) a VH comprising a VH CDR1, a VH CDR2, and a VH CDR3 having an amino acid sequence of SEQ ID NOs:3605, 3606, and 3607, respectively, and (ii) a VL comprising a VL CDR1, VL CDR2, and VL CDR3 having an amino acid sequence of SEQ ID NOs:3608, 3609, and 3610, respectively. In one aspect, provided herein is an antibody that binds TRDV2, comprising: (i) a VH comprising a VH CDR1, a VH CDR2, and a VH CDR3 having an amino acid sequence of SEQ ID NOs:3611, 3612, and 3613, respectively, and (ii) a VL comprising a VL CDR1, VL CDR2, and VL CDR3 having an amino acid sequence of SEQ ID NOs:3614, 3615, and 3616, respectively. In one aspect, provided herein is an antibody that binds TRDV2, comprising: (i) a VH comprising a VH CDR1, a VH CDR2, and a VH CDR3 having an amino acid sequence of SEQ ID NOs:3617, 3618, and 3619, respectively, and (ii) a VL comprising a VL CDR1, VL CDR2, and VL CDR3 having an amino acid sequence of SEQ ID NOs:3620, 3621, and 3622, respectively. In one aspect, provided herein is an antibody that binds TRDV2, comprising: (i) a VH comprising a VH CDR1, a VH CDR2, and a VH CDR3 having an amino acid sequence of SEQ ID NOs:3623, 3624, and 3625, respectively, and (ii) a VL comprising a VL CDR1, VL CDR2, and VL CDR3 having an amino acid sequence of SEQ ID NOs:3626, 3627, and 3628, respectively. In one aspect, provided herein is an antibody that binds TRDV2, comprising: (i) a VH comprising a VH CDR1, a VH CDR2, and a VH CDR3 having an amino acid sequence of SEQ ID NOs:3629, 3630, and 3631, respectively, and (ii) a VL comprising a VL CDR1, VL CDR2, and VL CDR3 having an amino acid sequence of SEQ ID NOs:3632, 3633, and 3634, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3635; and (ii) a VL comprising a VL CDR1, a VL CDR2, and a VL CDR3 having an amino acid sequence of a VL CDR1, a VL CDR2, and a VL CDR3, respectively, of SEQ ID NO:3636. In one aspect, provided herein is an antibody that binds TRDV2, comprising a VH having an amino acid sequence of SEQ ID NO:3635. In one aspect, provided herein is an antibody that binds TRDV2, comprising a VL having an amino acid sequence of SEQ ID NO:3636. In one aspect, provided herein is an antibody that binds TRDV2, comprising a VH having an amino acid sequence of SEQ ID NO:3635, and a VL having an amino acid sequence of SEQ ID NO:3636. In one aspect, provided herein is an antibody that binds TRDV2, comprising a heavy chain having an amino acid sequence of SEQ ID NO:3637. In one aspect, provided herein is an antibody that binds TRDV2, comprising a light chain having an amino acid sequence of SEQ ID NO:3638. In one aspect, provided herein is an antibody that binds TRDV2, comprising a heavy chain having an amino acid sequence of SEQ ID NO:3637, and a light chain having an amino acid sequence of SEQ ID NO:3638. In one aspect, provided herein is an antibody that binds TRDV2, comprising a VH having an amino acid sequence having at least 95% identity to an amino acid sequence of SEQ ID NO:3635. In one aspect, provided herein is an antibody that binds TRDV2, comprising a VL having an amino acid sequence having at least 95% identity to an amino acid sequence of SEQ ID NO:3636. In one aspect, provided herein is an antibody that binds TRDV2, comprising a VH having an amino acid sequence having at least 95% identity to an amino acid sequence of SEQ ID NO:3635, and a VL having an amino acid sequence having at least 95% identity to an amino acid sequence of SEQ ID NO:3636. In one aspect, provided herein is an antibody that binds TRDV2, comprising a heavy chain having an amino acid sequence having at least 95% identity to an amino acid sequence of SEQ ID NO:3637. In one aspect, provided herein is an antibody that binds TRDV2, comprising a light chain having an amino acid sequence having at least 95% identity to an amino acid sequence of SEQ ID NO:3638. In one aspect, provided herein is an antibody that binds TRDV2, comprising a heavy chain having an amino acid sequence having at least 95% identity to an amino acid sequence of SEQ ID NO:3637, and a light chain having an amino acid sequence having at least 95% identity to an amino acid sequence of SEQ ID NO:3638.

In one aspect, provided herein is an antibody that binds TRDV2, comprising: (i) a VH comprising a VH CDR1, a VH CDR2, and a VH CDR3 having an amino acid sequence of SEQ ID NOs:3639, 3640, and 3641, respectively, and (ii) a VL comprising a VL CDR1, VL CDR2, and VL CDR3 having an amino acid sequence of SEQ ID NOs:3642, 3643, and 3644, respectively. In one aspect, provided herein is an antibody that binds TRDV2, comprising: (i) a VH comprising a VH CDR1, a VH CDR2, and a VH CDR3 having an amino acid sequence of SEQ ID NOs:3645, 3646, and 3647, respectively, and (ii) a VL comprising a VL CDR1, VL CDR2, and VL CDR3 having an amino acid sequence of SEQ ID NOs:3648, 3649, and 3650, respectively. In one aspect, provided herein is an antibody that binds TRDV2, comprising: (i) a VH comprising a VH CDR1, a VH CDR2, and a VH CDR3 having an amino acid sequence of SEQ ID NOs:3651, 3652, and 3653, respectively, and (ii) a VL comprising a VL CDR1, VL CDR2, and VL CDR3 having an amino acid sequence of SEQ ID NOs:3654, 3655, and 3656, respectively. In one aspect, provided herein is an antibody that binds TRDV2, comprising: (i) a VH comprising a VH CDR1, a VH CDR2, and a VH CDR3 having an amino acid sequence of SEQ ID NOs:3657, 3658, and 3659, respectively, and (ii) a VL comprising a VL CDR1, VL CDR2, and VL CDR3 having an amino acid sequence of SEQ ID NOs:3660, 3661, and 3662, respectively. In one aspect, provided herein is an antibody that binds TRDV2, comprising: (i) a VH comprising a VH CDR1, a VH CDR2, and a VH CDR3 having an amino acid sequence of SEQ ID NOs:3663, 3664, and 3665, respectively, and (ii) a VL comprising a VL CDR1, VL CDR2, and VL CDR3 having an amino acid sequence of SEQ ID NOs:3666, 3667, and 3668, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3669; and (ii) a VL comprising a VL CDR1, a VL CDR2, and a VL CDR3 having an amino acid sequence of a VL CDR1, a VL CDR2, and a VL CDR3, respectively, of SEQ ID NO:3670. In one aspect, provided herein is an antibody that binds TRDV2, comprising a VH having an amino acid sequence of SEQ ID NO:3669. In one aspect, provided herein is an antibody that binds TRDV2, comprising a VL having an amino acid sequence of SEQ ID NO:3670. In one aspect, provided herein is an antibody that binds TRDV2, comprising a VH having an amino acid sequence of SEQ ID NO:3669, and a VL having an amino acid sequence of SEQ ID NO:3670. In one aspect, provided herein is an antibody that binds TRDV2, comprising a heavy chain having an amino acid sequence of SEQ ID NO:3671. In one aspect, provided herein is an antibody that binds TRDV2, comprising a light chain having an amino acid sequence of SEQ ID NO:3672. In one aspect, provided herein is an antibody that binds TRDV2, comprising a heavy chain having an amino acid sequence of SEQ ID NO:3671, and a light chain having an amino acid sequence of SEQ ID NO:3672. In one aspect, provided herein is an antibody that binds TRDV2, comprising a VH having an amino acid sequence having at least 95% identity to an amino acid sequence of SEQ ID NO:3669. In one aspect, provided herein is an antibody that binds TRDV2, comprising a VL having an amino acid sequence having at least 95% identity to an amino acid sequence of SEQ ID NO:3670. In one aspect, provided herein is an antibody that binds TRDV2, comprising a VH having an amino acid sequence having at least 95% identity to an amino acid sequence of SEQ ID NO:3669, and a VL having an amino acid sequence having at least 95% identity to an amino acid sequence of SEQ ID NO:3670. In one aspect, provided herein is an antibody that binds TRDV2, comprising a heavy chain having an amino acid sequence having at least 95% identity to an amino acid sequence of SEQ ID NO:3671. In one aspect, provided herein is an antibody that binds TRDV2, comprising a light chain having an amino acid sequence having at least 95% identity to an amino acid sequence of SEQ ID NO:3672. In one aspect, provided herein is an antibody that binds TRDV2, comprising a heavy chain having an amino acid sequence having at least 95% identity to an amino acid sequence of SEQ ID NO:3671, and a light chain having an amino acid sequence having at least 95% identity to an amino acid sequence of SEQ ID NO:3672.

In one aspect, provided herein is an antibody that binds TRDV2, comprising: (i) a VH comprising a VH CDR1, a VH CDR2, and a VH CDR3 having an amino acid sequence of SEQ ID NOs:3673, 3674, and 3675, respectively, and (ii) a VL comprising a VL CDR1, VL CDR2, and VL CDR3 having an amino acid sequence of SEQ ID NOs:3676, 3677, and 3678, respectively. In one aspect, provided herein is an antibody that binds TRDV2, comprising: (i) a VH comprising a VH CDR1, a VH CDR2, and a VH CDR3 having an amino acid sequence of SEQ ID NOs:3679, 3680, and 3681, respectively, and (ii) a VL comprising a VL CDR1, VL CDR2, and VL CDR3 having an amino acid sequence of SEQ ID NOs:3682, 3683, and 3684, respectively. In one aspect, provided herein is an antibody that binds TRDV2, comprising: (i) a VH comprising a VH CDR1, a VH CDR2, and a VH CDR3 having an amino acid sequence of SEQ ID NOs:3685, 3686, and 3687, respectively, and (ii) a VL comprising a VL CDR1, VL CDR2, and VL CDR3 having an amino acid sequence of SEQ ID NOs:3688, 3689, and 3690, respectively. In one aspect, provided herein is an antibody that binds TRDV2, comprising: (i) a VH comprising a VH CDR1, a VH CDR2, and a VH CDR3 having an amino acid sequence of SEQ ID NOs:3691, 3692, and 3693, respectively, and (ii) a VL comprising a VL CDR1, VL CDR2, and VL CDR3 having an amino acid sequence of SEQ ID NOs:3694, 3695, and 3696, respectively. In one aspect, provided herein is an antibody that binds TRDV2, comprising: (i) a VH comprising a VH CDR1, a VH CDR2, and a VH CDR3 having an amino acid sequence of SEQ ID NOs:3697, 3698, and 3699, respectively, and (ii) a VL comprising a VL CDR1, VL CDR2, and VL CDR3 having an amino acid sequence of SEQ ID NOs:3700, 3701, and 3702, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3703; and (ii) a VL comprising a VL CDR1, a VL CDR2, and a VL CDR3 having an amino acid sequence of a VL CDR1, a VL CDR2, and a VL CDR3, respectively, of SEQ ID NO:3704. In one aspect, provided herein is an antibody that binds TRDV2, comprising a VH having an amino acid sequence of SEQ ID NO:3703. In one aspect, provided herein is an antibody that binds TRDV2, comprising a VL having an amino acid sequence of SEQ ID NO:3704. In one aspect, provided herein is an antibody that binds TRDV2, comprising a VH having an amino acid sequence of SEQ ID NO:3703, and a VL having an amino acid sequence of SEQ ID NO:3704. In one aspect, provided herein is an antibody that binds TRDV2, comprising a heavy chain having an amino acid sequence of SEQ ID NO:3705. In one aspect, provided herein is an antibody that binds TRDV2, comprising a light chain having an amino acid sequence of SEQ ID NO:3706. In one aspect, provided herein is an antibody that binds TRDV2, comprising a heavy chain having an amino acid sequence of SEQ ID NO:3705, and a light chain having an amino acid sequence of SEQ ID NO:3706. In one aspect, provided herein is an antibody that binds TRDV2, comprising a VH having an amino acid sequence having at least 95% identity to an amino acid sequence of SEQ ID NO:3703. In one aspect, provided herein is an antibody that binds TRDV2, comprising a VL having an amino acid sequence having at least 95% identity to an amino acid sequence of SEQ ID NO:3704. In one aspect, provided herein is an antibody that binds TRDV2, comprising a VH having an amino acid sequence having at least 95% identity to an amino acid sequence of SEQ ID NO:3703, and a VL having an amino acid sequence having at least 95% identity to an amino acid sequence of SEQ ID NO:3704. In one aspect, provided herein is an antibody that binds TRDV2, comprising a heavy chain having an amino acid sequence having at least 95% identity to an amino acid sequence of SEQ ID NO:3705. In one aspect, provided herein is an antibody that binds TRDV2, comprising a light chain having an amino acid sequence having at least 95% identity to an amino acid sequence of SEQ ID NO:3706. In one aspect, provided herein is an antibody that binds TRDV2, comprising a heavy chain having an amino acid sequence having at least 95% identity to an amino acid sequence of SEQ ID NO:3705, and a light chain having an amino acid sequence having at least 95% identity to an amino acid sequence of SEQ ID NO:3706.

In one aspect, provided herein is an antibody that binds TRDV2, comprising: (i) a VH comprising a VH CDR1, a VH CDR2, and a VH CDR3 having an amino acid sequence of SEQ ID NOs:3707, 3708, and 3709, respectively, and (ii) a VL comprising a VL CDR1, VL CDR2, and VL CDR3 having an amino acid sequence of SEQ ID NOs:3710, 3711, and 3712, respectively. In one aspect, provided herein is an antibody that binds TRDV2, comprising: (i) a VH comprising a VH CDR1, a VH CDR2, and a VH CDR3 having an amino acid sequence of SEQ ID NOs:3713, 3714, and 3715, respectively, and (ii) a VL comprising a VL CDR1, VL CDR2, and VL CDR3 having an amino acid sequence of SEQ ID NOs:3716, 3717, and 3718, respectively. In one aspect, provided herein is an antibody that binds TRDV2, comprising: (i) a VH comprising a VH CDR1, a VH CDR2, and a VH CDR3 having an amino acid sequence of SEQ ID NOs:3719, 3720, and 3721, respectively, and (ii) a VL comprising a VL CDR1, VL CDR2, and VL CDR3 having an amino acid sequence of SEQ ID NOs:3722, 3723, and 3724, respectively. In one aspect, provided herein is an antibody that binds TRDV2, comprising: (i) a VH comprising a VH CDR1, a VH CDR2, and a VH CDR3 having an amino acid sequence of SEQ ID NOs:3725, 3726, and 3727, respectively, and (ii) a VL comprising a VL CDR1, VL CDR2, and VL CDR3 having an amino acid sequence of SEQ ID NOs:3728, 3729, and 3730, respectively. In one aspect, provided herein is an antibody that binds TRDV2, comprising: (i) a VH comprising a VH CDR1, a VH CDR2, and a VH CDR3 having an amino acid sequence of SEQ ID NOs:3731, 3732, and 3733, respectively, and (ii) a VL comprising a VL CDR1, VL CDR2, and VL CDR3 having an amino acid sequence of SEQ ID NOs:3734, 3735, and 3736, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3737; and (ii) a VL comprising a VL CDR1, a VL CDR2, and a VL CDR3 having an amino acid sequence of a VL CDR1, a VL CDR2, and a VL CDR3, respectively, of SEQ ID NO:3738. In one aspect, provided herein is an antibody that binds TRDV2, comprising a VH having an amino acid sequence of SEQ ID NO:3737. In one aspect, provided herein is an antibody that binds TRDV2, comprising a VL having an amino acid sequence of SEQ ID NO:3738. In one aspect, provided herein is an antibody that binds TRDV2, comprising a VH having an amino acid sequence of SEQ ID NO:3737, and a VL having an amino acid sequence of SEQ ID NO:3738. In one aspect, provided herein is an antibody that binds TRDV2, comprising a heavy chain having an amino acid sequence of SEQ ID NO:3739. In one aspect, provided herein is an antibody that binds TRDV2, comprising a light chain having an amino acid sequence of SEQ ID NO:3740. In one aspect, provided herein is an antibody that binds TRDV2, comprising a heavy chain having an amino acid sequence of SEQ ID NO:3739, and a light chain having an amino acid sequence of SEQ ID NO:3740. In one aspect, provided herein is an antibody that binds TRDV2, comprising a VH having an amino acid sequence having at least 95% identity to an amino acid sequence of SEQ ID NO:3737. In one aspect, provided herein is an antibody that binds TRDV2, comprising a VL having an amino acid sequence having at least 95% identity to an amino acid sequence of SEQ ID NO:3738. In one aspect, provided herein is an antibody that binds TRDV2, comprising a VH having an amino acid sequence having at least 95% identity to an amino acid sequence of SEQ ID NO:3737, and a VL having an amino acid sequence having at least 95% identity to an amino acid sequence of SEQ ID NO:3738. In one aspect, provided herein is an antibody that binds TRDV2, comprising a heavy chain having an amino acid sequence having at least 95% identity to an amino acid sequence of SEQ ID NO:3739. In one aspect, provided herein is an antibody that binds TRDV2, comprising a light chain having an amino acid sequence having at least 95% identity to an amino acid sequence of SEQ ID NO:3740. In one aspect, provided herein is an antibody that binds TRDV2, comprising a heavy chain having an amino acid sequence having at least 95% identity to an amino acid sequence of SEQ ID NO:3739, and a light chain having an amino acid sequence having at least 95% identity to an amino acid sequence of SEQ ID NO:3740.

In one aspect, provided herein is an antibody that binds TRDV2, comprising: (i) a VH comprising a VH CDR1, a VH CDR2, and a VH CDR3 having an amino acid sequence of SEQ ID NOs:3741, 3742, and 3743, respectively, and (ii) a VL comprising a VL CDR1, VL CDR2, and VL CDR3 having an amino acid sequence of SEQ ID NOs:3744, 3745, and 3746, respectively. In one aspect, provided herein is an antibody that binds TRDV2, comprising: (i) a VH comprising a VH CDR1, a VH CDR2, and a VH CDR3 having an amino acid sequence of SEQ ID NOs:3747, 3748, and 3749, respectively, and (ii) a VL comprising a VL CDR1, VL CDR2, and VL CDR3 having an amino acid sequence of SEQ ID NOs:3750, 3751, and 3752, respectively. In one aspect, provided herein is an antibody that binds TRDV2, comprising: (i) a VH comprising a VH CDR1, a VH CDR2, and a VH CDR3 having an amino acid sequence of SEQ ID NOs:3753, 3754, and 3755, respectively, and (ii) a VL comprising a VL CDR1, VL CDR2, and VL CDR3 having an amino acid sequence of SEQ ID NOs:3756, 3757, and 3758, respectively. In one aspect, provided herein is an antibody that binds TRDV2, comprising: (i) a VH comprising a VH CDR1, a VH CDR2, and a VH CDR3 having an amino acid sequence of SEQ ID NOs:3759, 3760, and 3761, respectively, and (ii) a VL comprising a VL CDR1, VL CDR2, and VL CDR3 having an amino acid sequence of SEQ ID NOs:3762, 3763, and 3764, respectively. In one aspect, provided herein is an antibody that binds TRDV2, comprising: (i) a VH comprising a VH CDR1, a VH CDR2, and a VH CDR3 having an amino acid sequence of SEQ ID NOs:3765, 3766, and 3767, respectively, and (ii) a VL comprising a VL CDR1, VL CDR2, and VL CDR3 having an amino acid sequence of SEQ ID NOs:3768, 3769, and 3770, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3771; and (ii) a VL comprising a VL CDR1, a VL CDR2, and a VL CDR3 having an amino acid sequence of a VL CDR1, a VL CDR2, and a VL CDR3, respectively, of SEQ ID NO:3772. In one aspect, provided herein is an antibody that binds TRDV2, comprising a VH having an amino acid sequence of SEQ ID NO:3771. In one aspect, provided herein is an antibody that binds TRDV2, comprising a VL having an amino acid sequence of SEQ ID NO:3772. In one aspect, provided herein is an antibody that binds TRDV2, comprising a VH having an amino acid sequence of SEQ ID NO:3771, and a VL having an amino acid sequence of SEQ ID NO:3772. In one aspect, provided herein is an antibody that binds TRDV2, comprising a heavy chain having an amino acid sequence of SEQ ID NO:3773. In one aspect, provided herein is an antibody that binds TRDV2, comprising a light chain having an amino acid sequence of SEQ ID NO:3774. In one aspect, provided herein is an antibody that binds TRDV2, comprising a heavy chain having an amino acid sequence of SEQ ID NO:3773, and a light chain having an amino acid sequence of SEQ ID NO:3774. In one aspect, provided herein is an antibody that binds TRDV2, comprising a VH having an amino acid sequence having at least 95% identity to an amino acid sequence of SEQ ID NO:3771. In one aspect, provided herein is an antibody that binds TRDV2, comprising a VL having an amino acid sequence having at least 95% identity to an amino acid sequence of SEQ ID NO:3772. In one aspect, provided herein is an antibody that binds TRDV2, comprising a VH having an amino acid sequence having at least 95% identity to an amino acid sequence of SEQ ID NO:3771, and a VL having an amino acid sequence having at least 95% identity to an amino acid sequence of SEQ ID NO:3772. In one aspect, provided herein is an antibody that binds TRDV2, comprising a heavy chain having an amino acid sequence having at least 95% identity to an amino acid sequence of SEQ ID NO:3773. In one aspect, provided herein is an antibody that binds TRDV2, comprising a light chain having an amino acid sequence having at least 95% identity to an amino acid sequence of SEQ ID NO:3774. In one aspect, provided herein is an antibody that binds TRDV2, comprising a heavy chain having an amino acid sequence having at least 95% identity to an amino acid sequence of SEQ ID NO:3773, and a light chain having an amino acid sequence having at least 95% identity to an amino acid sequence of SEQ ID NO:3774.

In one aspect, provided herein is an antibody that binds TRDV2, comprising: (i) a VH comprising a VH CDR1, a VH CDR2, and a VH CDR3 having an amino acid sequence of SEQ ID NOs:3775, 3776, and 3777, respectively, and (ii) a VL comprising a VL CDR1, VL CDR2, and VL CDR3 having an amino acid sequence of SEQ ID NOs:3778, 3779, and 3780, respectively. In one aspect, provided herein is an antibody that binds TRDV2, comprising: (i) a VH comprising a VH CDR1, a VH CDR2, and a VH CDR3 having an amino acid sequence of SEQ ID NOs:3781, 3782, and 3783, respectively, and (ii) a VL comprising a VL CDR1, VL CDR2, and VL CDR3 having an amino acid sequence of SEQ ID NOs:3784, 3785, and 3786, respectively. In one aspect, provided herein is an antibody that binds TRDV2, comprising: (i) a VH comprising a VH CDR1, a VH CDR2, and a VH CDR3 having an amino acid sequence of SEQ ID NOs:3787, 3788, and 3789, respectively, and (ii) a VL comprising a VL CDR1, VL CDR2, and VL CDR3 having an amino acid sequence of SEQ ID NOs:3790, 3791, and 3792, respectively. In one aspect, provided herein is an antibody that binds TRDV2, comprising: (i) a VH comprising a VH CDR1, a VH CDR2, and a VH CDR3 having an amino acid sequence of SEQ ID NOs:3793, 3794, and 3795, respectively, and (ii) a VL comprising a VL CDR1, VL CDR2, and VL CDR3 having an amino acid sequence of SEQ ID NOs:3796, 3797, and 3798, respectively. In one aspect, provided herein is an antibody that binds TRDV2, comprising: (i) a VH comprising a VH CDR1, a VH CDR2, and a VH CDR3 having an amino acid sequence of SEQ ID NOs:3799, 3800, and 3801, respectively, and (ii) a VL comprising a VL CDR1, VL CDR2, and VL CDR3 having an amino acid sequence of SEQ ID NOs:3802, 3803, and 3804, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3805; and (ii) a VL comprising a VL CDR1, a VL CDR2, and a VL CDR3 having an amino acid sequence of a VL CDR1, a VL CDR2, and a VL CDR3, respectively, of SEQ ID NO:3806. In one aspect, provided herein is an antibody that binds TRDV2, comprising a VH having an amino acid sequence of SEQ ID NO:3805. In one aspect, provided herein is an antibody that binds TRDV2, comprising a VL having an amino acid sequence of SEQ ID NO:3806. In one aspect, provided herein is an antibody that binds TRDV2, comprising a VH having an amino acid sequence of SEQ ID NO:3805, and a VL having an amino acid sequence of SEQ ID NO:3806. In one aspect, provided herein is an antibody that binds TRDV2, comprising a heavy chain having an amino acid sequence of SEQ ID NO:3807. In one aspect, provided herein is an antibody that binds TRDV2, comprising a light chain having an amino acid sequence of SEQ ID NO:3808. In one aspect, provided herein is an antibody that binds TRDV2, comprising a heavy chain having an amino acid sequence of SEQ ID NO:3807, and a light chain having an amino acid sequence of SEQ ID NO:3808. In one aspect, provided herein is an antibody that binds TRDV2, comprising a VH having an amino acid sequence having at least 95% identity to an amino acid sequence of SEQ ID NO:3805. In one aspect, provided herein is an antibody that binds TRDV2, comprising a VL having an amino acid sequence having at least 95% identity to an amino acid sequence of SEQ ID NO:3806. In one aspect, provided herein is an antibody that binds TRDV2, comprising a VH having an amino acid sequence having at least 95% identity to an amino acid sequence of SEQ ID NO:3805, and a VL having an amino acid sequence having at least 95% identity to an amino acid sequence of SEQ ID NO:3806. In one aspect, provided herein is an antibody that binds TRDV2, comprising a heavy chain having an amino acid sequence having at least 95% identity to an amino acid sequence of SEQ ID NO:3807. In one aspect, provided herein is an antibody that binds TRDV2, comprising a light chain having an amino acid sequence having at least 95% identity to an amino acid sequence of SEQ ID NO:3808. In one aspect, provided herein is an antibody that binds TRDV2, comprising a heavy chain having an amino acid sequence having at least 95% identity to an amino acid sequence of SEQ ID NO:3807, and a light chain having an amino acid sequence having at least 95% identity to an amino acid sequence of SEQ ID NO:3808.

In one aspect, provided herein is an antibody that binds TRDV2, comprising: (i) a VH comprising a VH CDR1, a VH CDR2, and a VH CDR3 having an amino acid sequence of SEQ ID NOs:3809, 3810, and 3811, respectively, and (ii) a VL comprising a VL CDR1, VL CDR2, and VL CDR3 having an amino acid sequence of SEQ ID NOs:3812, 3813, and 3814, respectively. In one aspect, provided herein is an antibody that binds TRDV2, comprising: (i) a VH comprising a VH CDR1, a VH CDR2, and a VH CDR3 having an amino acid sequence of SEQ ID NOs:3815, 3816, and 3817, respectively, and (ii) a VL comprising a VL CDR1, VL CDR2, and VL CDR3 having an amino acid sequence of SEQ ID NOs:3818, 3819, and 3820, respectively. In one aspect, provided herein is an antibody that binds TRDV2, comprising: (i) a VH comprising a VH CDR1, a VH CDR2, and a VH CDR3 having an amino acid sequence of SEQ ID NOs:3821, 3822, and 3823, respectively, and (ii) a VL comprising a VL CDR1, VL CDR2, and VL CDR3 having an amino acid sequence of SEQ ID NOs:3824, 3825, and 3826, respectively. In one aspect, provided herein is an antibody that binds TRDV2, comprising: (i) a VH comprising a VH CDR1, a VH CDR2, and a VH CDR3 having an amino acid sequence of SEQ ID NOs:3827, 3828, and 3829, respectively, and (ii) a VL comprising a VL CDR1, VL CDR2, and VL CDR3 having an amino acid sequence of SEQ ID NOs:3830, 3831, and 3832, respectively. In one aspect, provided herein is an antibody that binds TRDV2, comprising: (i) a VH comprising a VH CDR1, a VH CDR2, and a VH CDR3 having an amino acid sequence of SEQ ID NOs:3833, 3834, and 3835, respectively, and (ii) a VL comprising a VL CDR1, VL CDR2, and VL CDR3 having an amino acid sequence of SEQ ID NOs:3836, 3837, and 3838, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3839; and (ii) a VL comprising a VL CDR1, a VL CDR2, and a VL CDR3 having an amino acid sequence of a VL CDR1, a VL CDR2, and a VL CDR3, respectively, of SEQ ID NO:3840. In one aspect, provided herein is an antibody that binds TRDV2, comprising a VH having an amino acid sequence of SEQ ID NO:3839. In one aspect, provided herein is an antibody that binds TRDV2, comprising a VL having an amino acid sequence of SEQ ID NO:3840. In one aspect, provided herein is an antibody that binds TRDV2, comprising a VH having an amino acid sequence of SEQ ID NO:3839, and a VL having an amino acid sequence of SEQ ID NO:3840. In one aspect, provided herein is an antibody that binds TRDV2, comprising a heavy chain having an amino acid sequence of SEQ ID NO:3841. In one aspect, provided herein is an antibody that binds TRDV2, comprising a light chain having an amino acid sequence of SEQ ID NO:3842. In one aspect, provided herein is an antibody that binds TRDV2, comprising a heavy chain having an amino acid sequence of SEQ ID NO:3841, and a light chain having an amino acid sequence of SEQ ID NO:3842. In one aspect, provided herein is an antibody that binds TRDV2, comprising a VH having an amino acid sequence having at least 95% identity to an amino acid sequence of SEQ ID NO:3839. In one aspect, provided herein is an antibody that binds TRDV2, comprising a VL having an amino acid sequence having at least 95% identity to an amino acid sequence of SEQ ID NO:3840. In one aspect, provided herein is an antibody that binds TRDV2, comprising a VH having an amino acid sequence having at least 95% identity to an amino acid sequence of SEQ ID NO:3839, and a VL having an amino acid sequence having at least 95% identity to an amino acid sequence of SEQ ID NO:3840. In one aspect, provided herein is an antibody that binds TRDV2, comprising a heavy chain having an amino acid sequence having at least 95% identity to an amino acid sequence of SEQ ID NO:3841. In one aspect, provided herein is an antibody that binds TRDV2, comprising a light chain having an amino acid sequence having at least 95% identity to an amino acid sequence of SEQ ID NO:3842. In one aspect, provided herein is an antibody that binds TRDV2, comprising a heavy chain having an amino acid sequence having at least 95% identity to an amino acid sequence of SEQ ID NO:3841, and a light chain having an amino acid sequence having at least 95% identity to an amino acid sequence of SEQ ID NO:3842.

In one aspect, provided herein is an antibody that binds TRDV2, comprising: (i) a VH comprising a VH CDR1, a VH CDR2, and a VH CDR3 having an amino acid sequence of SEQ ID NOs:3843, 3844, and 3845, respectively, and (ii) a VL comprising a VL CDR1, VL CDR2, and VL CDR3 having an amino acid sequence of SEQ ID NOs:3846, 3847, and 3848, respectively. In one aspect, provided herein is an antibody that binds TRDV2, comprising: (i) a VH comprising a VH CDR1, a VH CDR2, and a VH CDR3 having an amino acid sequence of SEQ ID NOs:3849, 3850, and 3851, respectively, and (ii) a VL comprising a VL CDR1, VL CDR2, and VL CDR3 having an amino acid sequence of SEQ ID NOs:3852, 3853, and 3854, respectively. In one aspect, provided herein is an antibody that binds TRDV2, comprising: (i) a VH comprising a VH CDR1, a VH CDR2, and a VH CDR3 having an amino acid sequence of SEQ ID NOs:3855, 3856, and 3857, respectively, and (ii) a VL comprising a VL CDR1, VL CDR2, and VL CDR3 having an amino acid sequence of SEQ ID NOs:3858, 3859, and 3860, respectively. In one aspect, provided herein is an antibody that binds TRDV2, comprising: (i) a VH comprising a VH CDR1, a VH CDR2, and a VH CDR3 having an amino acid sequence of SEQ ID NOs:3861, 3862, and 3863, respectively, and (ii) a VL comprising a VL CDR1, VL CDR2, and VL CDR3 having an amino acid sequence of SEQ ID NOs:3864, 3865, and 3866, respectively. In one aspect, provided herein is an antibody that binds TRDV2, comprising: (i) a VH comprising a VH CDR1, a VH CDR2, and a VH CDR3 having an amino acid sequence of SEQ ID NOs:3867, 3868, and 3869, respectively, and (ii) a VL comprising a VL CDR1, VL CDR2, and VL CDR3 having an amino acid sequence of SEQ ID NOs:3870, 3871, and 3872, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3873; and (ii) a VL comprising a VL CDR1, a VL CDR2, and a VL CDR3 having an amino acid sequence of a VL CDR1, a VL CDR2, and a VL CDR3, respectively, of SEQ ID NO:3874. In one aspect, provided herein is an antibody that binds TRDV2, comprising a VH having an amino acid sequence of SEQ ID NO:3873. In one aspect, provided herein is an antibody that binds TRDV2, comprising a VL having an amino acid sequence of SEQ ID NO:3874. In one aspect, provided herein is an antibody that binds TRDV2, comprising a VH having an amino acid sequence of SEQ ID NO:3873, and a VL having an amino acid sequence of SEQ ID NO:3874. In one aspect, provided herein is an antibody that binds TRDV2, comprising a heavy chain having an amino acid sequence of SEQ ID NO:3875. In one aspect, provided herein is an antibody that binds TRDV2, comprising a light chain having an amino acid sequence of SEQ ID NO:3876. In one aspect, provided herein is an antibody that binds TRDV2, comprising a heavy chain having an amino acid sequence of SEQ ID NO:3875, and a light chain having an amino acid sequence of SEQ ID NO:3876. In one aspect, provided herein is an antibody that binds TRDV2, comprising a VH having an amino acid sequence having at least 95% identity to an amino acid sequence of SEQ ID NO:3873. In one aspect, provided herein is an antibody that binds TRDV2, comprising a VL having an amino acid sequence having at least 95% identity to an amino acid sequence of SEQ ID NO:3874. In one aspect, provided herein is an antibody that binds TRDV2, comprising a VH having an amino acid sequence having at least 95% identity to an amino acid sequence of SEQ ID NO:3873, and a VL having an amino acid sequence having at least 95% identity to an amino acid sequence of SEQ ID NO:3874. In one aspect, provided herein is an antibody that binds TRDV2, comprising a heavy chain having an amino acid sequence having at least 95% identity to an amino acid sequence of SEQ ID NO:3875. In one aspect, provided herein is an antibody that binds TRDV2, comprising a light chain having an amino acid sequence having at least 95% identity to an amino acid sequence of SEQ ID NO:3876. In one aspect, provided herein is an antibody that binds TRDV2, comprising a heavy chain having an amino acid sequence having at least 95% identity to an amino acid sequence of SEQ ID NO:3875, and a light chain having an amino acid sequence having at least 95% identity to an amino acid sequence of SEQ ID NO:3876.

In one aspect, provided herein is an antibody that binds TRDV2, comprising: (i) a VH comprising a VH CDR1, a VH CDR2, and a VH CDR3 having an amino acid sequence of SEQ ID NOs:3877, 3878, and 3879, respectively, and (ii) a VL comprising a VL CDR1, VL CDR2, and VL CDR3 having an amino acid sequence of SEQ ID NOs:3880, 3881, and 3882, respectively. In one aspect, provided herein is an antibody that binds TRDV2, comprising: (i) a VH comprising a VH CDR1, a VH CDR2, and a VH CDR3 having an amino acid sequence of SEQ ID NOs:3883, 3884, and 3885, respectively, and (ii) a VL comprising a VL CDR1, VL CDR2, and VL CDR3 having an amino acid sequence of SEQ ID NOs:3886, 3887, and 3888, respectively. In one aspect, provided herein is an antibody that binds TRDV2, comprising: (i) a VH comprising a VH CDR1, a VH CDR2, and a VH CDR3 having an amino acid sequence of SEQ ID NOs:3889, 3890, and 3891, respectively, and (ii) a VL comprising a VL CDR1, VL CDR2, and VL CDR3 having an amino acid sequence of SEQ ID NOs:3892, 3893, and 3894, respectively. In one aspect, provided herein is an antibody that binds TRDV2, comprising: (i) a VH comprising a VH CDR1, a VH CDR2, and a VH CDR3 having an amino acid sequence of SEQ ID NOs:3895, 3896, and 3897, respectively, and (ii) a VL comprising a VL CDR1, VL CDR2, and VL CDR3 having an amino acid sequence of SEQ ID NOs:3898, 3899, and 3900, respectively. In one aspect, provided herein is an antibody that binds TRDV2, comprising: (i) a VH comprising a VH CDR1, a VH CDR2, and a VH CDR3 having an amino acid sequence of SEQ ID NOs:3901, 3902, and 3903, respectively, and (ii) a VL comprising a VL CDR1, VL CDR2, and VL CDR3 having an amino acid sequence of SEQ ID NOs:3904, 3905, and 3906, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3907; and (ii) a VL comprising a VL CDR1, a VL CDR2, and a VL CDR3 having an amino acid sequence of a VL CDR1, a VL CDR2, and a VL CDR3, respectively, of SEQ ID NO:3908. In one aspect, provided herein is an antibody that binds TRDV2, comprising a VH having an amino acid sequence of SEQ ID NO:3907. In one aspect, provided herein is an antibody that binds TRDV2, comprising a VL having an amino acid sequence of SEQ ID NO:3908. In one aspect, provided herein is an antibody that binds TRDV2, comprising a VH having an amino acid sequence of SEQ ID NO:3907, and a VL having an amino acid sequence of SEQ ID NO:3908. In one aspect, provided herein is an antibody that binds TRDV2, comprising a heavy chain having an amino acid sequence of SEQ ID NO:3909. In one aspect, provided herein is an antibody that binds TRDV2, comprising a light chain having an amino acid sequence of SEQ ID NO:3910. In one aspect, provided herein is an antibody that binds TRDV2, comprising a heavy chain having an amino acid sequence of SEQ ID NO:3909, and a light chain having an amino acid sequence of SEQ ID NO:3910. In one aspect, provided herein is an antibody that binds TRDV2, comprising a VH having an amino acid sequence having at least 95% identity to an amino acid sequence of SEQ ID NO:3907. In one aspect, provided herein is an antibody that binds TRDV2, comprising a VL having an amino acid sequence having at least 95% identity to an amino acid sequence of SEQ ID NO:3908. In one aspect, provided herein is an antibody that binds TRDV2, comprising a VH having an amino acid sequence having at least 95% identity to an amino acid sequence of SEQ ID NO:3907, and a VL having an amino acid sequence having at least 95% identity to an amino acid sequence of SEQ ID NO:3908. In one aspect, provided herein is an antibody that binds TRDV2, comprising a heavy chain having an amino acid sequence having at least 95% identity to an amino acid sequence of SEQ ID NO:3909. In one aspect, provided herein is an antibody that binds TRDV2, comprising a light chain having an amino acid sequence having at least 95% identity to an amino acid sequence of SEQ ID NO:3910. In one aspect, provided herein is an antibody that binds TRDV2, comprising a heavy chain having an amino acid sequence having at least 95% identity to an amino acid sequence of SEQ ID NO:3909, and a light chain having an amino acid sequence having at least 95% identity to an amino acid sequence of SEQ ID NO:3910.

In one aspect, provided herein is an antibody that binds TRDV2, comprising: (i) a VH comprising a VH CDR1, a VH CDR2, and a VH CDR3 having an amino acid sequence of SEQ ID NOs:3911, 3912, and 3913, respectively, and (ii) a VL comprising a VL CDR1, VL CDR2, and VL CDR3 having an amino acid sequence of SEQ ID NOs:3914, 3915, and 3916, respectively. In one aspect, provided herein is an antibody that binds TRDV2, comprising: (i) a VH comprising a VH CDR1, a VH CDR2, and a VH CDR3 having an amino acid sequence of SEQ ID NOs:3917, 3918, and 3919, respectively, and (ii) a VL comprising a VL CDR1, VL CDR2, and VL CDR3 having an amino acid sequence of SEQ ID NOs:3920, 3921, and 3922, respectively. In one aspect, provided herein is an antibody that binds TRDV2, comprising: (i) a VH comprising a VH CDR1, a VH CDR2, and a VH CDR3 having an amino acid sequence of SEQ ID NOs:3923, 3924, and 3925, respectively, and (ii) a VL comprising a VL CDR1, VL CDR2, and VL CDR3 having an amino acid sequence of SEQ ID NOs:3926, 3927, and 3928, respectively. In one aspect, provided herein is an antibody that binds TRDV2, comprising: (i) a VH comprising a VH CDR1, a VH CDR2, and a VH CDR3 having an amino acid sequence of SEQ ID NOs:3929, 3930, and 3931, respectively, and (ii) a VL comprising a VL CDR1, VL CDR2, and VL CDR3 having an amino acid sequence of SEQ ID NOs:3932, 3933, and 3934, respectively. In one aspect, provided herein is an antibody that binds TRDV2, comprising: (i) a VH comprising a VH CDR1, a VH CDR2, and a VH CDR3 having an amino acid sequence of SEQ ID NOs:3935, 3936, and 3937, respectively, and (ii) a VL comprising a VL CDR1, VL CDR2, and VL CDR3 having an amino acid sequence of SEQ ID NOs:3938, 3939, and 3940, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3941; and (ii) a VL comprising a VL CDR1, a VL CDR2, and a VL CDR3 having an amino acid sequence of a VL CDR1, a VL CDR2, and a VL CDR3, respectively, of SEQ ID NO:3942. In one aspect, provided herein is an antibody that binds TRDV2, comprising a VH having an amino acid sequence of SEQ ID NO:3941. In one aspect, provided herein is an antibody that binds TRDV2, comprising a VL having an amino acid sequence of SEQ ID NO:3942. In one aspect, provided herein is an antibody that binds TRDV2, comprising a VH having an amino acid sequence of SEQ ID NO:3941, and a VL having an amino acid sequence of SEQ ID NO:3942. In one aspect, provided herein is an antibody that binds TRDV2, comprising a heavy chain having an amino acid sequence of SEQ ID NO:3943. In one aspect, provided herein is an antibody that binds TRDV2, comprising a light chain having an amino acid sequence of SEQ ID NO:3944. In one aspect, provided herein is an antibody that binds TRDV2, comprising a heavy chain having an amino acid sequence of SEQ ID NO:3943, and a light chain having an amino acid sequence of SEQ ID NO:3944. In one aspect, provided herein is an antibody that binds TRDV2, comprising a VH having an amino acid sequence having at least 95% identity to an amino acid sequence of SEQ ID NO:3941. In one aspect, provided herein is an antibody that binds TRDV2, comprising a VL having an amino acid sequence having at least 95% identity to an amino acid sequence of SEQ ID NO:3942. In one aspect, provided herein is an antibody that binds TRDV2, comprising a VH having an amino acid sequence having at least 95% identity to an amino acid sequence of SEQ ID NO:3941, and a VL having an amino acid sequence having at least 95% identity to an amino acid sequence of SEQ ID NO:3942. In one aspect, provided herein is an antibody that binds TRDV2, comprising a heavy chain having an amino acid sequence having at least 95% identity to an amino acid sequence of SEQ ID NO:3943. In one aspect, provided herein is an antibody that binds TRDV2, comprising a light chain having an amino acid sequence having at least 95% identity to an amino acid sequence of SEQ ID NO:3944. In one aspect, provided herein is an antibody that binds TRDV2, comprising a heavy chain having an amino acid sequence having at least 95% identity to an amino acid sequence of SEQ ID NO:3943, and a light chain having an amino acid sequence having at least 95% identity to an amino acid sequence of SEQ ID NO:3944.

In one aspect, provided herein is an antibody that binds TRDV2, comprising: (i) a VH comprising a VH CDR1, a VH CDR2, and a VH CDR3 having an amino acid sequence of SEQ ID NOs:3945, 3946, and 3947, respectively, and (ii) a VL comprising a VL CDR1, VL CDR2, and VL CDR3 having an amino acid sequence of SEQ ID NOs:3948, 3949, and 3950, respectively. In one aspect, provided herein is an antibody that binds TRDV2, comprising: (i) a VH comprising a VH CDR1, a VH CDR2, and a VH CDR3 having an amino acid sequence of SEQ ID NOs:3951, 3952, and 3953, respectively, and (ii) a VL comprising a VL CDR1, VL CDR2, and VL CDR3 having an amino acid sequence of SEQ ID NOs:3954, 3955, and 3956, respectively. In one aspect, provided herein is an antibody that binds TRDV2, comprising: (i) a VH comprising a VH CDR1, a VH CDR2, and a VH CDR3 having an amino acid sequence of SEQ ID NOs:3957, 3958, and 3959, respectively, and (ii) a VL comprising a VL CDR1, VL CDR2, and VL CDR3 having an amino acid sequence of SEQ ID NOs:3960, 3961, and 3962, respectively. In one aspect, provided herein is an antibody that binds TRDV2, comprising: (i) a VH comprising a VH CDR1, a VH CDR2, and a VH CDR3 having an amino acid sequence of SEQ ID NOs:3963, 3964, and 3965, respectively, and (ii) a VL comprising a VL CDR1, VL CDR2, and VL CDR3 having an amino acid sequence of SEQ ID NOs:3966, 3967, and 3968, respectively. In one aspect, provided herein is an antibody that binds TRDV2, comprising: (i) a VH comprising a VH CDR1, a VH CDR2, and a VH CDR3 having an amino acid sequence of SEQ ID NOs:3969, 3970, and 3971, respectively, and (ii) a VL comprising a VL CDR1, VL CDR2, and VL CDR3 having an amino acid sequence of SEQ ID NOs:3972, 3973, and 3974, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3975; and (ii) a VL comprising a VL CDR1, a VL CDR2, and a VL CDR3 having an amino acid sequence of a VL CDR1, a VL CDR2, and a VL CDR3, respectively, of SEQ ID NO:3976. In one aspect, provided herein is an antibody that binds TRDV2, comprising a VH having an amino acid sequence of SEQ ID NO:3975. In one aspect, provided herein is an antibody that binds TRDV2, comprising a VL having an amino acid sequence of SEQ ID NO:3976. In one aspect, provided herein is an antibody that binds TRDV2, comprising a VH having an amino acid sequence of SEQ ID NO:3975, and a VL having an amino acid sequence of SEQ ID NO:3976. In one aspect, provided herein is an antibody that binds TRDV2, comprising a heavy chain having an amino acid sequence of SEQ ID NO:3977. In one aspect, provided herein is an antibody that binds TRDV2, comprising a light chain having an amino acid sequence of SEQ ID NO:3978. In one aspect, provided herein is an antibody that binds TRDV2, comprising a heavy chain having an amino acid sequence of SEQ ID NO:3977, and a light chain having an amino acid sequence of SEQ ID NO:3978. In one aspect, provided herein is an antibody that binds TRDV2, comprising a VH having an amino acid sequence having at least 95% identity to an amino acid sequence of SEQ ID NO:3975. In one aspect, provided herein is an antibody that binds TRDV2, comprising a VL having an amino acid sequence having at least 95% identity to an amino acid sequence of SEQ ID NO:3976. In one aspect, provided herein is an antibody that binds TRDV2, comprising a VH having an amino acid sequence having at least 95% identity to an amino acid sequence of SEQ ID NO:3975, and a VL having an amino acid sequence having at least 95% identity to an amino acid sequence of SEQ ID NO:3976. In one aspect, provided herein is an antibody that binds TRDV2, comprising a heavy chain having an amino acid sequence having at least 95% identity to an amino acid sequence of SEQ ID NO:3977. In one aspect, provided herein is an antibody that binds TRDV2, comprising a light chain having an amino acid sequence having at least 95% identity to an amino acid sequence of SEQ ID NO:3978. In one aspect, provided herein is an antibody that binds TRDV2, comprising a heavy chain having an amino acid sequence having at least 95% identity to an amino acid sequence of SEQ ID NO:3977, and a light chain having an amino acid sequence having at least 95% identity to an amino acid sequence of SEQ ID NO:3978.

In one aspect, provided herein is an antibody that binds TRDV2, comprising: (i) a VH comprising a VH CDR1, a VH CDR2, and a VH CDR3 having an amino acid sequence of SEQ ID NOs:3979, 3980, and 3981, respectively, and (ii) a VL comprising a VL CDR1, VL CDR2, and VL CDR3 having an amino acid sequence of SEQ ID NOs:3982, 3983, and 3984, respectively. In one aspect, provided herein is an antibody that binds TRDV2, comprising: (i) a VH comprising a VH CDR1, a VH CDR2, and a VH CDR3 having an amino acid sequence of SEQ ID NOs:3985, 3986, and 3987, respectively, and (ii) a VL comprising a VL CDR1, VL CDR2, and VL CDR3 having an amino acid sequence of SEQ ID NOs:3988, 3989, and 3990, respectively. In one aspect, provided herein is an antibody that binds TRDV2, comprising: (i) a VH comprising a VH CDR1, a VH CDR2, and a VH CDR3 having an amino acid sequence of SEQ ID NOs:3991, 3992, and 3993, respectively, and (ii) a VL comprising a VL CDR1, VL CDR2, and VL CDR3 having an amino acid sequence of SEQ ID NOs:3994, 3995, and 3996, respectively. In one aspect, provided herein is an antibody that binds TRDV2, comprising: (i) a VH comprising a VH CDR1, a VH CDR2, and a VH CDR3 having an amino acid sequence of SEQ ID NOs:3997, 3998, and 3999, respectively, and (ii) a VL comprising a VL CDR1, VL CDR2, and VL CDR3 having an amino acid sequence of SEQ ID NOs:4000, 4001, and 4002, respectively. In one aspect, provided herein is an antibody that binds TRDV2, comprising: (i) a VH comprising a VH CDR1, a VH CDR2, and a VH CDR3 having an amino acid sequence of SEQ ID NOs:4003, 4004, and 4005, respectively, and (ii) a VL comprising a VL CDR1, VL CDR2, and VL CDR3 having an amino acid sequence of SEQ ID NOs:4006, 4007, and 4008, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4009; and (ii) a VL comprising a VL CDR1, a VL CDR2, and a VL CDR3 having an amino acid sequence of a VL CDR1, a VL CDR2, and a VL CDR3, respectively, of SEQ ID NO:4010. In one aspect, provided herein is an antibody that binds TRDV2, comprising a VH having an amino acid sequence of SEQ ID NO:4009. In one aspect, provided herein is an antibody that binds TRDV2, comprising a VL having an amino acid sequence of SEQ ID NO:4010. In one aspect, provided herein is an antibody that binds TRDV2, comprising a VH having an amino acid sequence of SEQ ID NO:4009, and a VL having an amino acid sequence of SEQ ID NO:4010. In one aspect, provided herein is an antibody that binds TRDV2, comprising a heavy chain having an amino acid sequence of SEQ ID NO:4011. In one aspect, provided herein is an antibody that binds TRDV2, comprising a light chain having an amino acid sequence of SEQ ID NO:4012. In one aspect, provided herein is an antibody that binds TRDV2, comprising a heavy chain having an amino acid sequence of SEQ ID NO:4011, and a light chain having an amino acid sequence of SEQ ID NO:4012. In one aspect, provided herein is an antibody that binds TRDV2, comprising a VH having an amino acid sequence having at least 95% identity to an amino acid sequence of SEQ ID NO:4009. In one aspect, provided herein is an antibody that binds TRDV2, comprising a VL having an amino acid sequence having at least 95% identity to an amino acid sequence of SEQ ID NO:4010. In one aspect, provided herein is an antibody that binds TRDV2, comprising a VH having an amino acid sequence having at least 95% identity to an amino acid sequence of SEQ ID NO:4009, and a VL having an amino acid sequence having at least 95% identity to an amino acid sequence of SEQ ID NO:4010. In one aspect, provided herein is an antibody that binds TRDV2, comprising a heavy chain having an amino acid sequence having at least 95% identity to an amino acid sequence of SEQ ID NO:4011. In one aspect, provided herein is an antibody that binds TRDV2, comprising a light chain having an amino acid sequence having at least 95% identity to an amino acid sequence of SEQ ID NO:4012. In one aspect, provided herein is an antibody that binds TRDV2, comprising a heavy chain having an amino acid sequence having at least 95% identity to an amino acid sequence of SEQ ID NO:4011, and a light chain having an amino acid sequence having at least 95% identity to an amino acid sequence of SEQ ID NO:4012.

In one aspect, provided herein is an antibody that binds TRDV2, comprising: (i) a VH comprising a VH CDR1, a VH CDR2, and a VH CDR3 having an amino acid sequence of SEQ ID NOs:4013, 4014, and 4015, respectively, and (ii) a VL comprising a VL CDR1, VL CDR2, and VL CDR3 having an amino acid sequence of SEQ ID NOs:4016, 4017, and 4018, respectively. In one aspect, provided herein is an antibody that binds TRDV2, comprising: (i) a VH comprising a VH CDR1, a VH CDR2, and a VH CDR3 having an amino acid sequence of SEQ ID NOs:4019, 4020, and 4021, respectively, and (ii) a VL comprising a VL CDR1, VL CDR2, and VL CDR3 having an amino acid sequence of SEQ ID NOs:4022, 4023, and 4024, respectively. In one aspect, provided herein is an antibody that binds TRDV2, comprising: (i) a VH comprising a VH CDR1, a VH CDR2, and a VH CDR3 having an amino acid sequence of SEQ ID NOs:4025, 4026, and 4027, respectively, and (ii) a VL comprising a VL CDR1, VL CDR2, and VL CDR3 having an amino acid sequence of SEQ ID NOs:4028, 4029, and 4030, respectively. In one aspect, provided herein is an antibody that binds TRDV2, comprising: (i) a VH comprising a VH CDR1, a VH CDR2, and a VH CDR3 having an amino acid sequence of SEQ ID NOs:4031, 4032, and 4033, respectively, and (ii) a VL comprising a VL CDR1, VL CDR2, and VL CDR3 having an amino acid sequence of SEQ ID NOs:4034, 4035, and 4036, respectively. In one aspect, provided herein is an antibody that binds TRDV2, comprising: (i) a VH comprising a VH CDR1, a VH CDR2, and a VH CDR3 having an amino acid sequence of SEQ ID NOs:4037, 4038, and 4039, respectively, and (ii) a VL comprising a VL CDR1, VL CDR2, and VL CDR3 having an amino acid sequence of SEQ ID NOs:4040, 4041, and 4042, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4043; and (ii) a VL comprising a VL CDR1, a VL CDR2, and a VL CDR3 having an amino acid sequence of a VL CDR1, a VL CDR2, and a VL CDR3, respectively, of SEQ ID NO:4044. In one aspect, provided herein is an antibody that binds TRDV2, comprising a VH having an amino acid sequence of SEQ ID NO:4043. In one aspect, provided herein is an antibody that binds TRDV2, comprising a VL having an amino acid sequence of SEQ ID NO:4044. In one aspect, provided herein is an antibody that binds TRDV2, comprising a VH having an amino acid sequence of SEQ ID NO:4043, and a VL having an amino acid sequence of SEQ ID NO:4044. In one aspect, provided herein is an antibody that binds TRDV2, comprising a heavy chain having an amino acid sequence of SEQ ID NO:4045. In one aspect, provided herein is an antibody that binds TRDV2, comprising a light chain having an amino acid sequence of SEQ ID NO:4046. In one aspect, provided herein is an antibody that binds TRDV2, comprising a heavy chain having an amino acid sequence of SEQ ID NO:4045, and a light chain having an amino acid sequence of SEQ ID NO:4046. In one aspect, provided herein is an antibody that binds TRDV2, comprising a VH having an amino acid sequence having at least 95% identity to an amino acid sequence of SEQ ID NO:4043. In one aspect, provided herein is an antibody that binds TRDV2, comprising a VL having an amino acid sequence having at least 95% identity to an amino acid sequence of SEQ ID NO:4044. In one aspect, provided herein is an antibody that binds TRDV2, comprising a VH having an amino acid sequence having at least 95% identity to an amino acid sequence of SEQ ID NO:4043, and a VL having an amino acid sequence having at least 95% identity to an amino acid sequence of SEQ ID NO:4044. In one aspect, provided herein is an antibody that binds TRDV2, comprising a heavy chain having an amino acid sequence having at least 95% identity to an amino acid sequence of SEQ ID NO:4045. In one aspect, provided herein is an antibody that binds TRDV2, comprising a light chain having an amino acid sequence having at least 95% identity to an amino acid sequence of SEQ ID NO:4046. In one aspect, provided herein is an antibody that binds TRDV2, comprising a heavy chain having an amino acid sequence having at least 95% identity to an amino acid sequence of SEQ ID NO:4045, and a light chain having an amino acid sequence having at least 95% identity to an amino acid sequence of SEQ ID NO:4046.

In one aspect, provided herein is an antibody that binds TRDV2, comprising: (i) a VH comprising a VH CDR1, a VH CDR2, and a VH CDR3 having an amino acid sequence of SEQ ID NOs:4047, 4048, and 4049, respectively, and (ii) a VL comprising a VL CDR1, VL CDR2, and VL CDR3 having an amino acid sequence of SEQ ID NOs:4050, 4051, and 4052, respectively. In one aspect, provided herein is an antibody that binds TRDV2, comprising: (i) a VH comprising a VH CDR1, a VH CDR2, and a VH CDR3 having an amino acid sequence of SEQ ID NOs:4053, 4054, and 4055, respectively, and (ii) a VL comprising a VL CDR1, VL CDR2, and VL CDR3 having an amino acid sequence of SEQ ID NOs:4056, 4057, and 4058, respectively. In one aspect, provided herein is an antibody that binds TRDV2, comprising: (i) a VH comprising a VH CDR1, a VH CDR2, and a VH CDR3 having an amino acid sequence of SEQ ID NOs:4059, 4060, and 4061, respectively, and (ii) a VL comprising a VL CDR1, VL CDR2, and VL CDR3 having an amino acid sequence of SEQ ID NOs:4062, 4063, and 4064, respectively. In one aspect, provided herein is an antibody that binds TRDV2, comprising: (i) a VH comprising a VH CDR1, a VH CDR2, and a VH CDR3 having an amino acid sequence of SEQ ID NOs:4065, 4066, and 4067, respectively, and (ii) a VL comprising a VL CDR1, VL CDR2, and VL CDR3 having an amino acid sequence of SEQ ID NOs:4068, 4069, and 4070, respectively. In one aspect, provided herein is an antibody that binds TRDV2, comprising: (i) a VH comprising a VH CDR1, a VH CDR2, and a VH CDR3 having an amino acid sequence of SEQ ID NOs:4071, 4072, and 4073, respectively, and (ii) a VL comprising a VL CDR1, VL CDR2, and VL CDR3 having an amino acid sequence of SEQ ID NOs:4074, 4075, and 4076, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4077; and (ii) a VL comprising a VL CDR1, a VL CDR2, and a VL CDR3 having an amino acid sequence of a VL CDR1, a VL CDR2, and a VL CDR3, respectively, of SEQ ID NO:4078. In one aspect, provided herein is an antibody that binds TRDV2, comprising a VH having an amino acid sequence of SEQ ID NO:4077. In one aspect, provided herein is an antibody that binds TRDV2, comprising a VL having an amino acid sequence of SEQ ID NO:4078. In one aspect, provided herein is an antibody that binds TRDV2, comprising a VH having an amino acid sequence of SEQ ID NO:4077, and a VL having an amino acid sequence of SEQ ID NO:4078. In one aspect, provided herein is an antibody that binds TRDV2, comprising a heavy chain having an amino acid sequence of SEQ ID NO:4079. In one aspect, provided herein is an antibody that binds TRDV2, comprising a light chain having an amino acid sequence of SEQ ID NO:4080. In one aspect, provided herein is an antibody that binds TRDV2, comprising a heavy chain having an amino acid sequence of SEQ ID NO:4079, and a light chain having an amino acid sequence of SEQ ID NO:4080. In one aspect, provided herein is an antibody that binds TRDV2, comprising a VH having an amino acid sequence having at least 95% identity to an amino acid sequence of SEQ ID NO:4077. In one aspect, provided herein is an antibody that binds TRDV2, comprising a VL having an amino acid sequence having at least 95% identity to an amino acid sequence of SEQ ID NO:4078. In one aspect, provided herein is an antibody that binds TRDV2, comprising a VH having an amino acid sequence having at least 95% identity to an amino acid sequence of SEQ ID NO:4077, and a VL having an amino acid sequence having at least 95% identity to an amino acid sequence of SEQ ID NO:4078. In one aspect, provided herein is an antibody that binds TRDV2, comprising a heavy chain having an amino acid sequence having at least 95% identity to an amino acid sequence of SEQ ID NO:4079. In one aspect, provided herein is an antibody that binds TRDV2, comprising a light chain having an amino acid sequence having at least 95% identity to an amino acid sequence of SEQ ID NO:4080. In one aspect, provided herein is an antibody that binds TRDV2, comprising a heavy chain having an amino acid sequence having at least 95% identity to an amino acid sequence of SEQ ID NO:4079, and a light chain having an amino acid sequence having at least 95% identity to an amino acid sequence of SEQ ID NO:4080.

In one aspect, provided herein is an antibody that binds TRDV2, comprising: (i) a VH comprising a VH CDR1, a VH CDR2, and a VH CDR3 having an amino acid sequence of SEQ ID NOs:4081, 4082, and 4083, respectively, and (ii) a VL comprising a VL CDR1, VL CDR2, and VL CDR3 having an amino acid sequence of SEQ ID NOs:4084, 4085, and 4086, respectively. In one aspect, provided herein is an antibody that binds TRDV2, comprising: (i) a VH comprising a VH CDR1, a VH CDR2, and a VH CDR3 having an amino acid sequence of SEQ ID NOs:4087, 4088, and 4089, respectively, and (ii) a VL comprising a VL CDR1, VL CDR2, and VL CDR3 having an amino acid sequence of SEQ ID NOs:4090, 4091, and 4092, respectively. In one aspect, provided herein is an antibody that binds TRDV2, comprising: (i) a VH comprising a VH CDR1, a VH CDR2, and a VH CDR3 having an amino acid sequence of SEQ ID NOs:4093, 4094, and 4095, respectively, and (ii) a VL comprising a VL CDR1, VL CDR2, and VL CDR3 having an amino acid sequence of SEQ ID NOs:4096, 4097, and 4098, respectively. In one aspect, provided herein is an antibody that binds TRDV2, comprising: (i) a VH comprising a VH CDR1, a VH CDR2, and a VH CDR3 having an amino acid sequence of SEQ ID NOs:4099, 4100, and 4101, respectively, and (ii) a VL comprising a VL CDR1, VL CDR2, and VL CDR3 having an amino acid sequence of SEQ ID NOs:4102, 4103, and 4104, respectively. In one aspect, provided herein is an antibody that binds TRDV2, comprising: (i) a VH comprising a VH CDR1, a VH CDR2, and a VH CDR3 having an amino acid sequence of SEQ ID NOs:4105, 4106, and 4107, respectively, and (ii) a VL comprising a VL CDR1, VL CDR2, and VL CDR3 having an amino acid sequence of SEQ ID NOs:4108, 4109, and 4110, respectively. In one aspect, provided herein is an antibody that binds TRDV2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4111; and (ii) a VL comprising a VL CDR1, a VL CDR2, and a VL CDR3 having an amino acid sequence of a VL CDR1, a VL CDR2, and a VL CDR3, respectively, of SEQ ID NO:4112. In one aspect, provided herein is an antibody that binds TRDV2, comprising a VH having an amino acid sequence of SEQ ID NO:4111. In one aspect, provided herein is an antibody that binds TRDV2, comprising a VL having an amino acid sequence of SEQ ID NO:4112. In one aspect, provided herein is an antibody that binds TRDV2, comprising a VH having an amino acid sequence of SEQ ID NO:4111, and a VL having an amino acid sequence of SEQ ID NO:4112. In one aspect, provided herein is an antibody that binds TRDV2, comprising a heavy chain having an amino acid sequence of SEQ ID NO:4113. In one aspect, provided herein is an antibody that binds TRDV2, comprising a light chain having an amino acid sequence of SEQ ID NO:4114. In one aspect, provided herein is an antibody that binds TRDV2, comprising a heavy chain having an amino acid sequence of SEQ ID NO:4113, and a light chain having an amino acid sequence of SEQ ID NO:4114. In one aspect, provided herein is an antibody that binds TRDV2, comprising a VH having an amino acid sequence having at least 95% identity to an amino acid sequence of SEQ ID NO:4111. In one aspect, provided herein is an antibody that binds TRDV2, comprising a VL having an amino acid sequence having at least 95% identity to an amino acid sequence of SEQ ID NO:4112. In one aspect, provided herein is an antibody that binds TRDV2, comprising a VH having an amino acid sequence having at least 95% identity to an amino acid sequence of SEQ ID NO:4111, and a VL having an amino acid sequence having at least 95% identity to an amino acid sequence of SEQ ID NO:4112. In one aspect, provided herein is an antibody that binds TRDV2, comprising a heavy chain having an amino acid sequence having at least 95% identity to an amino acid sequence of SEQ ID NO:4113. In one aspect, provided herein is an antibody that binds TRDV2, comprising a light chain having an amino acid sequence having at least 95% identity to an amino acid sequence of SEQ ID NO:4114. In one aspect, provided herein is an antibody that binds TRDV2, comprising a heavy chain having an amino acid sequence having at least 95% identity to an amino acid sequence of SEQ ID NO:4113, and a light chain having an amino acid sequence having at least 95% identity to an amino acid sequence of SEQ ID NO:4114.

In one aspect, provided herein is an antibody that binds TRDV2. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2207. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2208. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2207; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2208. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2241. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2242. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2241; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2242. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2275. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2276. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2275; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2276. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2309. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2310. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2309; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2310. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2343. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2344.

In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2343; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2344. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2377. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2378. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2377; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2378. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2411. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2412. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2411; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2412. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2445. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2446. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2445; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2446. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2479. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2480. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2479; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2480. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2513. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2514. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2513; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2514. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2547. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2548. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2547; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2548. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2581. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2582. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2581; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2582. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2615. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2616. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2615; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2616. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2649. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2650. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2649; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2650. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2683. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2684. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2683; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2684. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2717. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2718. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2717; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2718. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2751. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2752. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2751; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2752. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2785. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2786. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2785; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2786. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2819. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2820. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2819; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2820. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2853. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2854. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2853; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2854. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2887. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2888. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2887; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2888. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2921. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2922. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2921; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2922. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2955. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2956. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2955; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2956. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2989. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2990. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2989; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2990. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3023. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3024. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3023; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3024. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3057. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3058. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3057; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3058. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3091. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3092. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3091; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3092. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3125. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3126. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3125; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3126. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3159. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3160. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3159; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3160. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3193. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3194. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3193; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3194. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3227. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3228. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3227; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3228. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3261. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3262. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3261; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3262. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3295. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3296. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3295; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3296. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3329. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3330. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3329; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3330. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3363. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3364. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3363; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3364. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3397. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3398. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3397; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3398. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3431. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3432. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3431; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3432. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3465. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3466. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3465; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3466. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3499. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3500. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3499; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3500. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3533. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3534. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3533; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3534. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3567. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3568. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3567; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3568. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3601. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3602. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3601; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3602. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3635. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3636. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3635; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3636. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3669. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3670. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3669; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3670. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3703. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3704. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3703; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3704. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3737. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3738. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3737; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3738. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3771. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3772. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3771; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3772. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3805. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3806. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3805; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3806. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3839. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3840. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3839; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3840. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3873. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3874. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3873; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3874. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3907. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3908. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3907; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3908. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3941. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3942. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3941; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3942. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3975. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3976. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3975; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3976. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4009. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4010. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4009; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4010. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4043. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4044. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4043; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4044. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4077. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4078. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4077; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4078. In one embodiment, the TRDV2 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4111. In one embodiment, the TRDV2 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4112. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4111; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4112. In some embodiments, the TRDV2 antibody is a multispecific antibody. In some embodiments, the TRDV2 antibody is a bispecific antibody. In some embodiments, the TRDV2 antibody is a trispecific antibody. In some embodiments, the TRDV2 antibody is a quadraspecific antibody.

In one aspect, provided herein is an antibody that binds TRDV2, comprising a VH CDR1 having an amino acid sequence of SEQ ID NO:2031, wherein the fifth amino acid is R or S; a VH CDR2 having an amino acid sequence of SEQ ID NO:2032; a VH CDR3 having an amino acid sequence of SEQ ID NO:2033, wherein the sixteenth amino acid is F or Y. In one aspect, provided herein is an antibody that binds TRDV2, comprising a VL CDR1 having an amino acid sequence of SEQ ID NO:2034; a VL CDR2 having an amino acid sequence of SEQ ID NO:2035, wherein the third amino acid is S or T; and a VL CDR3 having an amino acid sequence of SEQ ID NO:2036, wherein the sixth amino acid is R or S, the seventh amino acid is L or M, the eighth amino acid is S or T. In one aspect, provided herein is an antibody that binds TRDV2, comprising a VH CDR1 having an amino acid sequence of SEQ ID NO:2031, wherein the fifth amino acid is R or S; a VH CDR2 having an amino acid sequence of SEQ ID NO:2032; a VH CDR3 having an amino acid sequence of SEQ ID NO:2033, wherein the sixteenth amino acid is F or Y; a VL CDR1 having an amino acid sequence of SEQ ID NO:2034; a VL CDR2 having an amino acid sequence of SEQ ID NO:2035, wherein the third amino acid is S or T; and a VL CDR3 having an amino acid sequence of SEQ ID NO:2036, wherein the sixth amino acid is R or S, the seventh amino acid is L or M, the eighth amino acid is S or T.

In one aspect, provided herein is an antibody that binds TRDV2, comprising a VH CDR1 having an amino acid sequence of SEQ ID NO:2099, wherein the fifth amino acid is S or T, the eighth amino acid is R or S; a VH CDR2 having an amino acid sequence of SEQ ID NO:2100, wherein the fourth amino acid is D or S, the sixth amino acid is I or S; a VH CDR3 having an amino acid sequence of SEQ ID NO:2101, wherein the third amino acid is D or E, the fourth amino acid is R or S, the sixth amino acid is Y or there is no amino acid added to the sixth position and sequence continues to the seventh position, the eighth amino acid is G or V, the ninth amino acid is P or S. In one aspect, provided herein is an antibody that binds TRDV2, comprising a VL CDR1 having an amino acid sequence of SEQ ID NO:2102; a VL CDR2 having an amino acid sequence of SEQ ID NO:2103; and a VL CDR3 having an amino acid sequence of SEQ ID NO:2104. In one aspect, provided herein is an antibody that binds TRDV2, comprising a VH CDR1 having an amino acid sequence of SEQ ID NO:2099, wherein the fifth amino acid is S or T, the eighth amino acid is R or S; a VH CDR2 having an amino acid sequence of SEQ ID NO:2100, wherein the fourth amino acid is D or S, the sixth amino acid is I or S; a VH CDR3 having an amino acid sequence of SEQ ID NO:2101, wherein the third amino acid is D or E, the fourth amino acid is R or S, the sixth amino acid is Y or there is no amino acid added to the sixth position and sequence continues to the seventh position, the eighth amino acid is G or V, the ninth amino acid is P or S; a VL CDR1 having an amino acid sequence of SEQ ID NO:2102; a VL CDR2 having an amino acid sequence of SEQ ID NO:2103; and a VL CDR3 having an amino acid sequence of SEQ ID NO:2104.

In one aspect, provided herein is an antibody that binds TRDV2, comprising a VH CDR1 having an amino acid sequence of SEQ ID NO:2133, wherein the second amino acid is D or G, the fifth amino acid is N, S, or T, the sixth amino acid is N or S, the seventh amino acid is H or Y; a VH CDR2 having an amino acid sequence of SEQ ID NO:2134, wherein the first amino acid is I or V, the fourth amino acid is N or S, the sixth amino acid is N or S; a VH CDR3 having an amino acid sequence of SEQ ID NO:2135, wherein the seventh amino acid is E or V, the tenth amino acid is G or T. In one aspect, provided herein is an antibody that binds TRDV2, comprising a VL CDR1 having an amino acid sequence of SEQ ID NO:2136; a VL CDR2 having an amino acid sequence of SEQ ID NO:2137; and a VL CDR3 having an amino acid sequence of SEQ ID NO:2138, wherein the ninth amino acid is G or S. In one aspect, provided herein is an antibody that binds TRDV2, comprising a VH CDR1 having an amino acid sequence of SEQ ID NO:2133, wherein the second amino acid is D or G, the fifth amino acid is N, S, or T, the sixth amino acid is N or S, the seventh amino acid is H or Y; a VH CDR2 having an amino acid sequence of SEQ ID NO:2134, wherein the first amino acid is I or V, the fourth amino acid is N or S, the sixth amino acid is N or S; a VH CDR3 having an amino acid sequence of SEQ ID NO:2135, wherein the seventh amino acid is E or V, the tenth amino acid is G or T; a VL CDR1 having an amino acid sequence of SEQ ID NO:2136; a VL CDR2 having an amino acid sequence of SEQ ID NO:2137; and a VL CDR3 having an amino acid sequence of SEQ ID NO:2138, wherein the ninth amino acid is G or S.

In one aspect, provided herein is an antibody that binds TRDV2, comprising a VH CDR1 having an amino acid sequence of SEQ ID NO:2269, wherein the first amino acid is G or S, the fifth amino acid is S or T; a VH CDR2 having an amino acid sequence of SEQ ID NO:2270; a VH CDR3 having an amino acid sequence of SEQ ID NO:2271, wherein the seventh amino acid is D or E, the ninth amino acid is D or S, the eighteenth amino acid is G or N. In one aspect, provided herein is an antibody that binds TRDV2, comprising a VL CDR1 having an amino acid sequence of SEQ ID NO:2272; a VL CDR2 having an amino acid sequence of SEQ ID NO:2273; and a VL CDR3 having an amino acid sequence of SEQ ID NO:2274, wherein the third amino acid is F or Y, the sixth amino acid is A or T. In one aspect, provided herein is an antibody that binds TRDV2, comprising a VH CDR1 having an amino acid sequence of SEQ ID NO:2269, wherein the first amino acid is G or S, the fifth amino acid is S or T; a VH CDR2 having an amino acid sequence of SEQ ID NO:2270; a VH CDR3 having an amino acid sequence of SEQ ID NO:2271, wherein the seventh amino acid is D or E, the ninth amino acid is D or S, the eighteenth amino acid is G or N; a VL CDR1 having an amino acid sequence of SEQ ID NO:2272; a VL CDR2 having an amino acid sequence of SEQ ID NO:2273; and a VL CDR3 having an amino acid sequence of SEQ ID NO:2274, wherein the third amino acid is F or Y, the sixth amino acid is A or T.

In one aspect, provided herein is an antibody that binds TRDV2, comprising a VH CDR1 having an amino acid sequence of SEQ ID NO:2337, wherein the first amino acid is G or N, the fifth amino acid is N or S, the sixth amino acid is G, N, or Y; a VH CDR2 having an amino acid sequence of SEQ ID NO:2338, wherein the second amino acid is F or Y; a VH CDR3 having an amino acid sequence of SEQ ID NO:2339, wherein the second amino acid is K or R, the third amino acid is E or L, the tenth amino acid is S or T, the eleventh amino acid is A or T. In one aspect, provided herein is an antibody that binds TRDV2, comprising a VL CDR1 having an amino acid sequence of SEQ ID NO:2340, wherein the first amino acid is S or T, the fifth amino acid is E or G, the seventh amino acid is D or N; a VL CDR2 having an amino acid sequence of SEQ ID NO:2341; and a VL CDR3 having an amino acid sequence of SEQ ID NO:2342, wherein the first amino acid is A or T. In one aspect, provided herein is an antibody that binds TRDV2, comprising a VH CDR1 having an amino acid sequence of SEQ ID NO:2337, wherein the first amino acid is G or N, the fifth amino acid is N or S, the sixth amino acid is G, N, or Y; a VH CDR2 having an amino acid sequence of SEQ ID NO:2338, wherein the second amino acid is F or Y; a VH CDR3 having an amino acid sequence of SEQ ID NO:2339, wherein the second amino acid is K or R, the third amino acid is E or L, the tenth amino acid is S or T, the eleventh amino acid is A or T; a VL CDR1 having an amino acid sequence of SEQ ID NO:2340, wherein the first amino acid is S or T, the fifth amino acid is E or G, the seventh amino acid is D or N; a VL CDR2 having an amino acid sequence of SEQ ID NO:2341; and a VL CDR3 having an amino acid sequence of SEQ ID NO:2342, wherein the first amino acid is A or T.

In one aspect, provided herein is an antibody that binds TRDV2, comprising a VH CDR1 having an amino acid sequence of SEQ ID NO:3017, wherein the sixth amino acid is S or T; a VH CDR2 having an amino acid sequence of SEQ ID NO:3018; a VH CDR3 having an amino acid sequence of SEQ ID NO:3019, wherein the eighth amino acid is S or T. In one aspect, provided herein is an antibody that binds TRDV2, comprising a VL CDR1 having an amino acid sequence of SEQ ID NO:3020, wherein the second amino acid is G or S; a VL CDR2 having an amino acid sequence of SEQ ID NO:3021; and a VL CDR3 having an amino acid sequence of SEQ ID NO:3022, wherein the first amino acid is I or M. In one aspect, provided herein is an antibody that binds TRDV2, comprising a VH CDR1 having an amino acid sequence of SEQ ID NO:3017, wherein the sixth amino acid is S or T; a VH CDR2 having an amino acid sequence of SEQ ID NO:3018; a VH CDR3 having an amino acid sequence of SEQ ID NO:3019, wherein the eighth amino acid is S or T; a VL CDR1 having an amino acid sequence of SEQ ID NO:3020, wherein the second amino acid is G or S; a VL CDR2 having an amino acid sequence of SEQ ID NO:3021; and a VL CDR3 having an amino acid sequence of SEQ ID NO:3022, wherein the first amino acid is I or M.

In one aspect, provided herein is an antibody that binds TRDV2, comprising a VH CDR1 having an amino acid sequence of SEQ ID NO:2983; a VH CDR2 having an amino acid sequence of SEQ ID NO:2984, wherein the third amino acid is P or S; a VH CDR3 having an amino acid sequence of SEQ ID NO:2985, wherein the fourth amino acid is M or V, the sixth amino acid is T or V, the eleventh amino acid is A or D. In one aspect, provided herein is an antibody that binds TRDV2, comprising a VL CDR1 having an amino acid sequence of SEQ ID NO:2986; a VL CDR2 having an amino acid sequence of SEQ ID NO:2987; and a VL CDR3 having an amino acid sequence of SEQ ID NO:2988. In one aspect, provided herein is an antibody that binds TRDV2, comprising a VH CDR1 having an amino acid sequence of SEQ ID NO:2983; a VH CDR2 having an amino acid sequence of SEQ ID NO:2984, wherein the third amino acid is P or S; a VH CDR3 having an amino acid sequence of SEQ ID NO:2985, wherein the fourth amino acid is M or V, the sixth amino acid is T or V, the eleventh amino acid is A or D; a VL CDR1 having an amino acid sequence of SEQ ID NO:2986; a VL CDR2 having an amino acid sequence of SEQ ID NO:2987; and a VL CDR3 having an amino acid sequence of SEQ ID NO:2988.

In one aspect, provided herein is an antibody that binds to TRGDC. In some embodiments, the antibody comprises a heavy chain variable region and a light chain variable region. In some embodiments, the TRGDC antibody is a humanized antibody.

In one aspect, provided herein is an antibody that binds TRGDC, comprising: (i) a VH comprising a VH CDR1, a VH CDR2, and a VH CDR3 having an amino acid sequence of SEQ ID NOs:4115, 4116, and 4117, respectively, and (ii) a VL comprising a VL CDR1, VL CDR2, and VL CDR3 having an amino acid sequence of SEQ ID NOs:4118, 4119, and 4120, respectively. In one aspect, provided herein is an antibody that binds TRGDC, comprising: (i) a VH comprising a VH CDR1, a VH CDR2, and a VH CDR3 having an amino acid sequence of SEQ ID NOs:4121, 4122, and 4123, respectively, and (ii) a VL comprising a VL CDR1, VL CDR2, and VL CDR3 having an amino acid sequence of SEQ ID NOs:4124, 4125, and 4126, respectively. In one aspect, provided herein is an antibody that binds TRGDC, comprising: (i) a VH comprising a VH CDR1, a VH CDR2, and a VH CDR3 having an amino acid sequence of SEQ ID NOs:4127, 4128, and 4129, respectively, and (ii) a VL comprising a VL CDR1, VL CDR2, and VL CDR3 having an amino acid sequence of SEQ ID NOs:4130, 4131, and 4132, respectively. In one aspect, provided herein is an antibody that binds TRGDC, comprising: (i) a VH comprising a VH CDR1, a VH CDR2, and a VH CDR3 having an amino acid sequence of SEQ ID NOs:4133, 4134, and 4135, respectively, and (ii) a VL comprising a VL CDR1, VL CDR2, and VL CDR3 having an amino acid sequence of SEQ ID NOs:4136, 4137, and 4138, respectively. In one aspect, provided herein is an antibody that binds TRGDC, comprising: (i) a VH comprising a VH CDR1, a VH CDR2, and a VH CDR3 having an amino acid sequence of SEQ ID NOs:4139, 4140, and 4141, respectively, and (ii) a VL comprising a VL CDR1, VL CDR2, and VL CDR3 having an amino acid sequence of SEQ ID NOs:4142, 4143, and 4144, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4145; and (ii) a VL comprising a VL CDR1, a VL CDR2, and a VL CDR3 having an amino acid sequence of a VL CDR1, a VL CDR2, and a VL CDR3, respectively, of SEQ ID NO:4146. In one aspect, provided herein is an antibody that binds TRGDC, comprising a VH having an amino acid sequence of SEQ ID NO:4145. In one aspect, provided herein is an antibody that binds TRGDC, comprising a VL having an amino acid sequence of SEQ ID NO:4146. In one aspect, provided herein is an antibody that binds TRGDC, comprising a VH having an amino acid sequence of SEQ ID NO:4145, and a VL having an amino acid sequence of SEQ ID NO:4146. In one aspect, provided herein is an antibody that binds TRGDC, comprising a heavy chain having an amino acid sequence of SEQ ID NO:4147. In one aspect, provided herein is an antibody that binds TRGDC, comprising a light chain having an amino acid sequence of SEQ ID NO:4148. In one aspect, provided herein is an antibody that binds TRGDC, comprising a heavy chain having an amino acid sequence of SEQ ID NO:4147, and a light chain having an amino acid sequence of SEQ ID NO:4148. In one aspect, provided herein is an antibody that binds TRGDC, comprising a VH having an amino acid sequence having at least 95% identity to an amino acid sequence of SEQ ID NO:4145. In one aspect, provided herein is an antibody that binds TRGDC, comprising a VL having an amino acid sequence having at least 95% identity to an amino acid sequence of SEQ ID NO:4146. In one aspect, provided herein is an antibody that binds TRGDC, comprising a VH having an amino acid sequence having at least 95% identity to an amino acid sequence of SEQ ID NO:4145, and a VL having an amino acid sequence having at least 95% identity to an amino acid sequence of SEQ ID NO:4146. In one aspect, provided herein is an antibody that binds TRGDC, comprising a heavy chain having an amino acid sequence having at least 95% identity to an amino acid sequence of SEQ ID NO:4147. In one aspect, provided herein is an antibody that binds TRGDC, comprising a light chain having an amino acid sequence having at least 95% identity to an amino acid sequence of SEQ ID NO:4148. In one aspect, provided herein is an antibody that binds TRGDC, comprising a heavy chain having an amino acid sequence having at least 95% identity to an amino acid sequence of SEQ ID NO:4147, and a light chain having an amino acid sequence having at least 95% identity to an amino acid sequence of SEQ ID NO:4148.

In one aspect, provided herein is an antibody that binds TRGDC, comprising: (i) a VH comprising a VH CDR1, a VH CDR2, and a VH CDR3 having an amino acid sequence of SEQ ID NOs:4149, 4150, and 4151, respectively, and (ii) a VL comprising a VL CDR1, VL CDR2, and VL CDR3 having an amino acid sequence of SEQ ID NOs:4152, 4153, and 4154, respectively. In one aspect, provided herein is an antibody that binds TRGDC, comprising: (i) a VH comprising a VH CDR1, a VH CDR2, and a VH CDR3 having an amino acid sequence of SEQ ID NOs:4155, 4156, and 4157, respectively, and (ii) a VL comprising a VL CDR1, VL CDR2, and VL CDR3 having an amino acid sequence of SEQ ID NOs:4158, 4159, and 4160, respectively. In one aspect, provided herein is an antibody that binds TRGDC, comprising: (i) a VH comprising a VH CDR1, a VH CDR2, and a VH CDR3 having an amino acid sequence of SEQ ID NOs:4161, 4162, and 4163, respectively, and (ii) a VL comprising a VL CDR1, VL CDR2, and VL CDR3 having an amino acid sequence of SEQ ID NOs:4164, 4165, and 4166, respectively. In one aspect, provided herein is an antibody that binds TRGDC, comprising: (i) a VH comprising a VH CDR1, a VH CDR2, and a VH CDR3 having an amino acid sequence of SEQ ID NOs:4167, 4168, and 4169, respectively, and (ii) a VL comprising a VL CDR1, VL CDR2, and VL CDR3 having an amino acid sequence of SEQ ID NOs:4170, 4171, and 4172, respectively. In one aspect, provided herein is an antibody that binds TRGDC, comprising: (i) a VH comprising a VH CDR1, a VH CDR2, and a VH CDR3 having an amino acid sequence of SEQ ID NOs:4173, 4174, and 4175, respectively, and (ii) a VL comprising a VL CDR1, VL CDR2, and VL CDR3 having an amino acid sequence of SEQ ID NOs:4176, 4177, and 4178, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4179; and (ii) a VL comprising a VL CDR1, a VL CDR2, and a VL CDR3 having an amino acid sequence of a VL CDR1, a VL CDR2, and a VL CDR3, respectively, of SEQ ID NO:4180. In one aspect, provided herein is an antibody that binds TRGDC, comprising a VH having an amino acid sequence of SEQ ID NO:4179. In one aspect, provided herein is an antibody that binds TRGDC, comprising a VL having an amino acid sequence of SEQ ID NO:4180. In one aspect, provided herein is an antibody that binds TRGDC, comprising a VH having an amino acid sequence of SEQ ID NO:4179, and a VL having an amino acid sequence of SEQ ID NO:4180. In one aspect, provided herein is an antibody that binds TRGDC, comprising a heavy chain having an amino acid sequence of SEQ ID NO:4181. In one aspect, provided herein is an antibody that binds TRGDC, comprising a light chain having an amino acid sequence of SEQ ID NO:4182. In one aspect, provided herein is an antibody that binds TRGDC, comprising a heavy chain having an amino acid sequence of SEQ ID NO:4181, and a light chain having an amino acid sequence of SEQ ID NO:4182. In one aspect, provided herein is an antibody that binds TRGDC, comprising a VH having an amino acid sequence having at least 95% identity to an amino acid sequence of SEQ ID NO:4179. In one aspect, provided herein is an antibody that binds TRGDC, comprising a VL having an amino acid sequence having at least 95% identity to an amino acid sequence of SEQ ID NO:4180. In one aspect, provided herein is an antibody that binds TRGDC, comprising a VH having an amino acid sequence having at least 95% identity to an amino acid sequence of SEQ ID NO:4179, and a VL having an amino acid sequence having at least 95% identity to an amino acid sequence of SEQ ID NO:4180. In one aspect, provided herein is an antibody that binds TRGDC, comprising a heavy chain having an amino acid sequence having at least 95% identity to an amino acid sequence of SEQ ID NO:4181. In one aspect, provided herein is an antibody that binds TRGDC, comprising a light chain having an amino acid sequence having at least 95% identity to an amino acid sequence of SEQ ID NO:4182. In one aspect, provided herein is an antibody that binds TRGDC, comprising a heavy chain having an amino acid sequence having at least 95% identity to an amino acid sequence of SEQ ID NO:4181, and a light chain having an amino acid sequence having at least 95% identity to an amino acid sequence of SEQ ID NO:4182.

In one aspect, provided herein is an antibody that binds TRGDC, comprising: (i) a VH comprising a VH CDR1, a VH CDR2, and a VH CDR3 having an amino acid sequence of SEQ ID NOs:4183, 4184, and 4185, respectively, and (ii) a VL comprising a VL CDR1, VL CDR2, and VL CDR3 having an amino acid sequence of SEQ ID NOs:4186, 4187, and 4188, respectively. In one aspect, provided herein is an antibody that binds TRGDC, comprising: (i) a VH comprising a VH CDR1, a VH CDR2, and a VH CDR3 having an amino acid sequence of SEQ ID NOs:4189, 4190, and 4191, respectively, and (ii) a VL comprising a VL CDR1, VL CDR2, and VL CDR3 having an amino acid sequence of SEQ ID NOs:4192, 4193, and 4194, respectively. In one aspect, provided herein is an antibody that binds TRGDC, comprising: (i) a VH comprising a VH CDR1, a VH CDR2, and a VH CDR3 having an amino acid sequence of SEQ ID NOs:4195, 4196, and 4197, respectively, and (ii) a VL comprising a VL CDR1, VL CDR2, and VL CDR3 having an amino acid sequence of SEQ ID NOs:4198, 4199, and 4200, respectively. In one aspect, provided herein is an antibody that binds TRGDC, comprising: (i) a VH comprising a VH CDR1, a VH CDR2, and a VH CDR3 having an amino acid sequence of SEQ ID NOs:4201, 4202, and 4203, respectively, and (ii) a VL comprising a VL CDR1, VL CDR2, and VL CDR3 having an amino acid sequence of SEQ ID NOs:4204, 4205, and 4206, respectively. In one aspect, provided herein is an antibody that binds TRGDC, comprising: (i) a VH comprising a VH CDR1, a VH CDR2, and a VH CDR3 having an amino acid sequence of SEQ ID NOs:4207, 4208, and 4209, respectively, and (ii) a VL comprising a VL CDR1, VL CDR2, and VL CDR3 having an amino acid sequence of SEQ ID NOs:4210, 4211, and 4212, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4213; and (ii) a VL comprising a VL CDR1, a VL CDR2, and a VL CDR3 having an amino acid sequence of a VL CDR1, a VL CDR2, and a VL CDR3, respectively, of SEQ ID NO:4214. In one aspect, provided herein is an antibody that binds TRGDC, comprising a VH having an amino acid sequence of SEQ ID NO:4213. In one aspect, provided herein is an antibody that binds TRGDC, comprising a VL having an amino acid sequence of SEQ ID NO:4214. In one aspect, provided herein is an antibody that binds TRGDC, comprising a VH having an amino acid sequence of SEQ ID NO:4213, and a VL having an amino acid sequence of SEQ ID NO:4214. In one aspect, provided herein is an antibody that binds TRGDC, comprising a heavy chain having an amino acid sequence of SEQ ID NO:4215. In one aspect, provided herein is an antibody that binds TRGDC, comprising a light chain having an amino acid sequence of SEQ ID NO:4216. In one aspect, provided herein is an antibody that binds TRGDC, comprising a heavy chain having an amino acid sequence of SEQ ID NO:4215, and a light chain having an amino acid sequence of SEQ ID NO:4216. In one aspect, provided herein is an antibody that binds TRGDC, comprising a VH having an amino acid sequence having at least 95% identity to an amino acid sequence of SEQ ID NO:4213. In one aspect, provided herein is an antibody that binds TRGDC, comprising a VL having an amino acid sequence having at least 95% identity to an amino acid sequence of SEQ ID NO:4214. In one aspect, provided herein is an antibody that binds TRGDC, comprising a VH having an amino acid sequence having at least 95% identity to an amino acid sequence of SEQ ID NO:4213, and a VL having an amino acid sequence having at least 95% identity to an amino acid sequence of SEQ ID NO:4214. In one aspect, provided herein is an antibody that binds TRGDC, comprising a heavy chain having an amino acid sequence having at least 95% identity to an amino acid sequence of SEQ ID NO:4215. In one aspect, provided herein is an antibody that binds TRGDC, comprising a light chain having an amino acid sequence having at least 95% identity to an amino acid sequence of SEQ ID NO:4216. In one aspect, provided herein is an antibody that binds TRGDC, comprising a heavy chain having an amino acid sequence having at least 95% identity to an amino acid sequence of SEQ ID NO:4215, and a light chain having an amino acid sequence having at least 95% identity to an amino acid sequence of SEQ ID NO:4216.

In one aspect, provided herein is an antibody that binds TRGDC, comprising: (i) a VH comprising a VH CDR1, a VH CDR2, and a VH CDR3 having an amino acid sequence of SEQ ID NOs:4217, 4218, and 4219, respectively, and (ii) a VL comprising a VL CDR1, VL CDR2, and VL CDR3 having an amino acid sequence of SEQ ID NOs:4220, 4221, and 4222, respectively. In one aspect, provided herein is an antibody that binds TRGDC, comprising: (i) a VH comprising a VH CDR1, a VH CDR2, and a VH CDR3 having an amino acid sequence of SEQ ID NOs:4223, 4224, and 4225, respectively, and (ii) a VL comprising a VL CDR1, VL CDR2, and VL CDR3 having an amino acid sequence of SEQ ID NOs:4226, 4227, and 4228, respectively. In one aspect, provided herein is an antibody that binds TRGDC, comprising: (i) a VH comprising a VH CDR1, a VH CDR2, and a VH CDR3 having an amino acid sequence of SEQ ID NOs:4229, 4230, and 4231, respectively, and (ii) a VL comprising a VL CDR1, VL CDR2, and VL CDR3 having an amino acid sequence of SEQ ID NOs:4232, 4233, and 4234, respectively. In one aspect, provided herein is an antibody that binds TRGDC, comprising: (i) a VH comprising a VH CDR1, a VH CDR2, and a VH CDR3 having an amino acid sequence of SEQ ID NOs:4235, 4236, and 4237, respectively, and (ii) a VL comprising a VL CDR1, VL CDR2, and VL CDR3 having an amino acid sequence of SEQ ID NOs:4238, 4239, and 4240, respectively. In one aspect, provided herein is an antibody that binds TRGDC, comprising: (i) a VH comprising a VH CDR1, a VH CDR2, and a VH CDR3 having an amino acid sequence of SEQ ID NOs:4241, 4242, and 4243, respectively, and (ii) a VL comprising a VL CDR1, VL CDR2, and VL CDR3 having an amino acid sequence of SEQ ID NOs:4244, 4245, and 4246, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4247; and (ii) a VL comprising a VL CDR1, a VL CDR2, and a VL CDR3 having an amino acid sequence of a VL CDR1, a VL CDR2, and a VL CDR3, respectively, of SEQ ID NO:4248. In one aspect, provided herein is an antibody that binds TRGDC, comprising a VH having an amino acid sequence of SEQ ID NO:4247. In one aspect, provided herein is an antibody that binds TRGDC, comprising a VL having an amino acid sequence of SEQ ID NO:4248. In one aspect, provided herein is an antibody that binds TRGDC, comprising a VH having an amino acid sequence of SEQ ID NO:4247, and a VL having an amino acid sequence of SEQ ID NO:4248. In one aspect, provided herein is an antibody that binds TRGDC, comprising a heavy chain having an amino acid sequence of SEQ ID NO:4249. In one aspect, provided herein is an antibody that binds TRGDC, comprising a light chain having an amino acid sequence of SEQ ID NO:4250. In one aspect, provided herein is an antibody that binds TRGDC, comprising a heavy chain having an amino acid sequence of SEQ ID NO:4249, and a light chain having an amino acid sequence of SEQ ID NO:4250. In one aspect, provided herein is an antibody that binds TRGDC, comprising a VH having an amino acid sequence having at least 95% identity to an amino acid sequence of SEQ ID NO:4247. In one aspect, provided herein is an antibody that binds TRGDC, comprising a VL having an amino acid sequence having at least 95% identity to an amino acid sequence of SEQ ID NO:4248. In one aspect, provided herein is an antibody that binds TRGDC, comprising a VH having an amino acid sequence having at least 95% identity to an amino acid sequence of SEQ ID NO:4247, and a VL having an amino acid sequence having at least 95% identity to an amino acid sequence of SEQ ID NO:4248. In one aspect, provided herein is an antibody that binds TRGDC, comprising a heavy chain having an amino acid sequence having at least 95% identity to an amino acid sequence of SEQ ID NO:4249. In one aspect, provided herein is an antibody that binds TRGDC, comprising a light chain having an amino acid sequence having at least 95% identity to an amino acid sequence of SEQ ID NO:4250. In one aspect, provided herein is an antibody that binds TRGDC, comprising a heavy chain having an amino acid sequence having at least 95% identity to an amino acid sequence of SEQ ID NO:4249, and a light chain having an amino acid sequence having at least 95% identity to an amino acid sequence of SEQ ID NO:4250.

In one aspect, provided herein is an antibody that binds TRGDC, comprising: (i) a VH comprising a VH CDR1, a VH CDR2, and a VH CDR3 having an amino acid sequence of SEQ ID NOs:4251, 4252, and 4253, respectively, and (ii) a VL comprising a VL CDR1, VL CDR2, and VL CDR3 having an amino acid sequence of SEQ ID NOs:4254, 4255, and 4256, respectively. In one aspect, provided herein is an antibody that binds TRGDC, comprising: (i) a VH comprising a VH CDR1, a VH CDR2, and a VH CDR3 having an amino acid sequence of SEQ ID NOs:4257, 4258, and 4259, respectively, and (ii) a VL comprising a VL CDR1, VL CDR2, and VL CDR3 having an amino acid sequence of SEQ ID NOs:4260, 4261, and 4262, respectively. In one aspect, provided herein is an antibody that binds TRGDC, comprising: (i) a VH comprising a VH CDR1, a VH CDR2, and a VH CDR3 having an amino acid sequence of SEQ ID NOs:4263, 4264, and 4265, respectively, and (ii) a VL comprising a VL CDR1, VL CDR2, and VL CDR3 having an amino acid sequence of SEQ ID NOs:4266, 4267, and 4268, respectively. In one aspect, provided herein is an antibody that binds TRGDC, comprising: (i) a VH comprising a VH CDR1, a VH CDR2, and a VH CDR3 having an amino acid sequence of SEQ ID NOs:4269, 4270, and 4271, respectively, and (ii) a VL comprising a VL CDR1, VL CDR2, and VL CDR3 having an amino acid sequence of SEQ ID NOs:4272, 4273, and 4274, respectively. In one aspect, provided herein is an antibody that binds TRGDC, comprising: (i) a VH comprising a VH CDR1, a VH CDR2, and a VH CDR3 having an amino acid sequence of SEQ ID NOs:4275, 4276, and 4277, respectively, and (ii) a VL comprising a VL CDR1, VL CDR2, and VL CDR3 having an amino acid sequence of SEQ ID NOs:4278, 4279, and 4280, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4281; and (ii) a VL comprising a VL CDR1, a VL CDR2, and a VL CDR3 having an amino acid sequence of a VL CDR1, a VL CDR2, and a VL CDR3, respectively, of SEQ ID NO:4282. In one aspect, provided herein is an antibody that binds TRGDC, comprising a VH having an amino acid sequence of SEQ ID NO:4281. In one aspect, provided herein is an antibody that binds TRGDC, comprising a VL having an amino acid sequence of SEQ ID NO:4282. In one aspect, provided herein is an antibody that binds TRGDC, comprising a VH having an amino acid sequence of SEQ ID NO:4281, and a VL having an amino acid sequence of SEQ ID NO:4282. In one aspect, provided herein is an antibody that binds TRGDC, comprising a heavy chain having an amino acid sequence of SEQ ID NO:4283. In one aspect, provided herein is an antibody that binds TRGDC, comprising a light chain having an amino acid sequence of SEQ ID NO:4284. In one aspect, provided herein is an antibody that binds TRGDC, comprising a heavy chain having an amino acid sequence of SEQ ID NO:4283, and a light chain having an amino acid sequence of SEQ ID NO:4284. In one aspect, provided herein is an antibody that binds TRGDC, comprising a VH having an amino acid sequence having at least 95% identity to an amino acid sequence of SEQ ID NO:4281. In one aspect, provided herein is an antibody that binds TRGDC, comprising a VL having an amino acid sequence having at least 95% identity to an amino acid sequence of SEQ ID NO:4282. In one aspect, provided herein is an antibody that binds TRGDC, comprising a VH having an amino acid sequence having at least 95% identity to an amino acid sequence of SEQ ID NO:4281, and a VL having an amino acid sequence having at least 95% identity to an amino acid sequence of SEQ ID NO:4282. In one aspect, provided herein is an antibody that binds TRGDC, comprising a heavy chain having an amino acid sequence having at least 95% identity to an amino acid sequence of SEQ ID NO:4283. In one aspect, provided herein is an antibody that binds TRGDC, comprising a light chain having an amino acid sequence having at least 95% identity to an amino acid sequence of SEQ ID NO:4284. In one aspect, provided herein is an antibody that binds TRGDC, comprising a heavy chain having an amino acid sequence having at least 95% identity to an amino acid sequence of SEQ ID NO:4283, and a light chain having an amino acid sequence having at least 95% identity to an amino acid sequence of SEQ ID NO:4284.

In one aspect, provided herein is an antibody that binds TRGDC, comprising: (i) a VH comprising a VH CDR1, a VH CDR2, and a VH CDR3 having an amino acid sequence of SEQ ID NOs:4285, 4286, and 4287, respectively, and (ii) a VL comprising a VL CDR1, VL CDR2, and VL CDR3 having an amino acid sequence of SEQ ID NOs:4288, 4289, and 4290, respectively. In one aspect, provided herein is an antibody that binds TRGDC, comprising: (i) a VH comprising a VH CDR1, a VH CDR2, and a VH CDR3 having an amino acid sequence of SEQ ID NOs:4291, 4292, and 4293, respectively, and (ii) a VL comprising a VL CDR1, VL CDR2, and VL CDR3 having an amino acid sequence of SEQ ID NOs:4294, 4295, and 4296, respectively. In one aspect, provided herein is an antibody that binds TRGDC, comprising: (i) a VH comprising a VH CDR1, a VH CDR2, and a VH CDR3 having an amino acid sequence of SEQ ID NOs:4297, 4298, and 4299, respectively, and (ii) a VL comprising a VL CDR1, VL CDR2, and VL CDR3 having an amino acid sequence of SEQ ID NOs:4300, 4301, and 4302, respectively. In one aspect, provided herein is an antibody that binds TRGDC, comprising: (i) a VH comprising a VH CDR1, a VH CDR2, and a VH CDR3 having an amino acid sequence of SEQ ID NOs:4303, 4304, and 4305, respectively, and (ii) a VL comprising a VL CDR1, VL CDR2, and VL CDR3 having an amino acid sequence of SEQ ID NOs:4306, 4307, and 4308, respectively. In one aspect, provided herein is an antibody that binds TRGDC, comprising: (i) a VH comprising a VH CDR1, a VH CDR2, and a VH CDR3 having an amino acid sequence of SEQ ID NOs:4309, 4310, and 4311, respectively, and (ii) a VL comprising a VL CDR1, VL CDR2, and VL CDR3 having an amino acid sequence of SEQ ID NOs:4312, 4313, and 4314, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4315; and (ii) a VL comprising a VL CDR1, a VL CDR2, and a VL CDR3 having an amino acid sequence of a VL CDR1, a VL CDR2, and a VL CDR3, respectively, of SEQ ID NO:4316. In one aspect, provided herein is an antibody that binds TRGDC, comprising a VH having an amino acid sequence of SEQ ID NO:4315. In one aspect, provided herein is an antibody that binds TRGDC, comprising a VL having an amino acid sequence of SEQ ID NO:4316. In one aspect, provided herein is an antibody that binds TRGDC, comprising a VH having an amino acid sequence of SEQ ID NO:4315, and a VL having an amino acid sequence of SEQ ID NO:4316. In one aspect, provided herein is an antibody that binds TRGDC, comprising a heavy chain having an amino acid sequence of SEQ ID NO:4317. In one aspect, provided herein is an antibody that binds TRGDC, comprising a light chain having an amino acid sequence of SEQ ID NO:4318. In one aspect, provided herein is an antibody that binds TRGDC, comprising a heavy chain having an amino acid sequence of SEQ ID NO:4317, and a light chain having an amino acid sequence of SEQ ID NO:4318. In one aspect, provided herein is an antibody that binds TRGDC, comprising a VH having an amino acid sequence having at least 95% identity to an amino acid sequence of SEQ ID NO:4315. In one aspect, provided herein is an antibody that binds TRGDC, comprising a VL having an amino acid sequence having at least 95% identity to an amino acid sequence of SEQ ID NO:4316. In one aspect, provided herein is an antibody that binds TRGDC, comprising a VH having an amino acid sequence having at least 95% identity to an amino acid sequence of SEQ ID NO:4315, and a VL having an amino acid sequence having at least 95% identity to an amino acid sequence of SEQ ID NO:4316. In one aspect, provided herein is an antibody that binds TRGDC, comprising a heavy chain having an amino acid sequence having at least 95% identity to an amino acid sequence of SEQ ID NO:4317. In one aspect, provided herein is an antibody that binds TRGDC, comprising a light chain having an amino acid sequence having at least 95% identity to an amino acid sequence of SEQ ID NO:4318. In one aspect, provided herein is an antibody that binds TRGDC, comprising a heavy chain having an amino acid sequence having at least 95% identity to an amino acid sequence of SEQ ID NO:4317, and a light chain having an amino acid sequence having at least 95% identity to an amino acid sequence of SEQ ID NO:4318.

In one aspect, provided herein is an antibody that binds TRGDC, comprising: (i) a VH comprising a VH CDR1, a VH CDR2, and a VH CDR3 having an amino acid sequence of SEQ ID NOs:4319, 4320, and 4321, respectively, and (ii) a VL comprising a VL CDR1, VL CDR2, and VL CDR3 having an amino acid sequence of SEQ ID NOs:4322, 4323, and 4324, respectively. In one aspect, provided herein is an antibody that binds TRGDC, comprising: (i) a VH comprising a VH CDR1, a VH CDR2, and a VH CDR3 having an amino acid sequence of SEQ ID NOs:4325, 4326, and 4327, respectively, and (ii) a VL comprising a VL CDR1, VL CDR2, and VL CDR3 having an amino acid sequence of SEQ ID NOs:4328, 4329, and 4330, respectively. In one aspect, provided herein is an antibody that binds TRGDC, comprising: (i) a VH comprising a VH CDR1, a VH CDR2, and a VH CDR3 having an amino acid sequence of SEQ ID NOs:4331, 4332, and 4333, respectively, and (ii) a VL comprising a VL CDR1, VL CDR2, and VL CDR3 having an amino acid sequence of SEQ ID NOs:4334, 4335, and 4336, respectively. In one aspect, provided herein is an antibody that binds TRGDC, comprising: (i) a VH comprising a VH CDR1, a VH CDR2, and a VH CDR3 having an amino acid sequence of SEQ ID NOs:4337, 4338, and 4339, respectively, and (ii) a VL comprising a VL CDR1, VL CDR2, and VL CDR3 having an amino acid sequence of SEQ ID NOs:4340, 4341, and 4342, respectively. In one aspect, provided herein is an antibody that binds TRGDC, comprising: (i) a VH comprising a VH CDR1, a VH CDR2, and a VH CDR3 having an amino acid sequence of SEQ ID NOs:4343, 4344, and 4345, respectively, and (ii) a VL comprising a VL CDR1, VL CDR2, and VL CDR3 having an amino acid sequence of SEQ ID NOs:4346, 4347, and 4348, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4349; and (ii) a VL comprising a VL CDR1, a VL CDR2, and a VL CDR3 having an amino acid sequence of a VL CDR1, a VL CDR2, and a VL CDR3, respectively, of SEQ ID NO:4350. In one aspect, provided herein is an antibody that binds TRGDC, comprising a VH having an amino acid sequence of SEQ ID NO:4349. In one aspect, provided herein is an antibody that binds TRGDC, comprising a VL having an amino acid sequence of SEQ ID NO:4350. In one aspect, provided herein is an antibody that binds TRGDC, comprising a VH having an amino acid sequence of SEQ ID NO:4349, and a VL having an amino acid sequence of SEQ ID NO:4350. In one aspect, provided herein is an antibody that binds TRGDC, comprising a heavy chain having an amino acid sequence of SEQ ID NO:4351. In one aspect, provided herein is an antibody that binds TRGDC, comprising a light chain having an amino acid sequence of SEQ ID NO:4352. In one aspect, provided herein is an antibody that binds TRGDC, comprising a heavy chain having an amino acid sequence of SEQ ID NO:4351, and a light chain having an amino acid sequence of SEQ ID NO:4352. In one aspect, provided herein is an antibody that binds TRGDC, comprising a VH having an amino acid sequence having at least 95% identity to an amino acid sequence of SEQ ID NO:4349. In one aspect, provided herein is an antibody that binds TRGDC, comprising a VL having an amino acid sequence having at least 95% identity to an amino acid sequence of SEQ ID NO:4350. In one aspect, provided herein is an antibody that binds TRGDC, comprising a VH having an amino acid sequence having at least 95% identity to an amino acid sequence of SEQ ID NO:4349, and a VL having an amino acid sequence having at least 95% identity to an amino acid sequence of SEQ ID NO:4350. In one aspect, provided herein is an antibody that binds TRGDC, comprising a heavy chain having an amino acid sequence having at least 95% identity to an amino acid sequence of SEQ ID NO:4351. In one aspect, provided herein is an antibody that binds TRGDC, comprising a light chain having an amino acid sequence having at least 95% identity to an amino acid sequence of SEQ ID NO:4352. In one aspect, provided herein is an antibody that binds TRGDC, comprising a heavy chain having an amino acid sequence having at least 95% identity to an amino acid sequence of SEQ ID NO:4351, and a light chain having an amino acid sequence having at least 95% identity to an amino acid sequence of SEQ ID NO:4352.

In one aspect, provided herein is an antibody that binds TRGDC, comprising: (i) a VH comprising a VH CDR1, a VH CDR2, and a VH CDR3 having an amino acid sequence of SEQ ID NOs:4353, 4354, and 4355, respectively, and (ii) a VL comprising a VL CDR1, VL CDR2, and VL CDR3 having an amino acid sequence of SEQ ID NOs:4356, 4357, and 4358, respectively. In one aspect, provided herein is an antibody that binds TRGDC, comprising: (i) a VH comprising a VH CDR1, a VH CDR2, and a VH CDR3 having an amino acid sequence of SEQ ID NOs:4359, 4360, and 4361, respectively, and (ii) a VL comprising a VL CDR1, VL CDR2, and VL CDR3 having an amino acid sequence of SEQ ID NOs:4362, 4363, and 4364, respectively. In one aspect, provided herein is an antibody that binds TRGDC, comprising: (i) a VH comprising a VH CDR1, a VH CDR2, and a VH CDR3 having an amino acid sequence of SEQ ID NOs:4365, 4366, and 4367, respectively, and (ii) a VL comprising a VL CDR1, VL CDR2, and VL CDR3 having an amino acid sequence of SEQ ID NOs:4368, 4369, and 4370, respectively. In one aspect, provided herein is an antibody that binds TRGDC, comprising: (i) a VH comprising a VH CDR1, a VH CDR2, and a VH CDR3 having an amino acid sequence of SEQ ID NOs:4371, 4372, and 4373, respectively, and (ii) a VL comprising a VL CDR1, VL CDR2, and VL CDR3 having an amino acid sequence of SEQ ID NOs:4374, 4375, and 4376, respectively. In one aspect, provided herein is an antibody that binds TRGDC, comprising: (i) a VH comprising a VH CDR1, a VH CDR2, and a VH CDR3 having an amino acid sequence of SEQ ID NOs:4377, 4378, and 4379, respectively, and (ii) a VL comprising a VL CDR1, VL CDR2, and VL CDR3 having an amino acid sequence of SEQ ID NOs:4380, 4381, and 4382, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4383; and (ii) a VL comprising a VL CDR1, a VL CDR2, and a VL CDR3 having an amino acid sequence of a VL CDR1, a VL CDR2, and a VL CDR3, respectively, of SEQ ID NO:4384. In one aspect, provided herein is an antibody that binds TRGDC, comprising a VH having an amino acid sequence of SEQ ID NO:4383. In one aspect, provided herein is an antibody that binds TRGDC, comprising a VL having an amino acid sequence of SEQ ID NO:4384. In one aspect, provided herein is an antibody that binds TRGDC, comprising a VH having an amino acid sequence of SEQ ID NO:4383, and a VL having an amino acid sequence of SEQ ID NO:4384. In one aspect, provided herein is an antibody that binds TRGDC, comprising a heavy chain having an amino acid sequence of SEQ ID NO:4385. In one aspect, provided herein is an antibody that binds TRGDC, comprising a light chain having an amino acid sequence of SEQ ID NO:4386. In one aspect, provided herein is an antibody that binds TRGDC, comprising a heavy chain having an amino acid sequence of SEQ ID NO:4385, and a light chain having an amino acid sequence of SEQ ID NO:4386. In one aspect, provided herein is an antibody that binds TRGDC, comprising a VH having an amino acid sequence having at least 95% identity to an amino acid sequence of SEQ ID NO:4383. In one aspect, provided herein is an antibody that binds TRGDC, comprising a VL having an amino acid sequence having at least 95% identity to an amino acid sequence of SEQ ID NO:4384. In one aspect, provided herein is an antibody that binds TRGDC, comprising a VH having an amino acid sequence having at least 95% identity to an amino acid sequence of SEQ ID NO:4383, and a VL having an amino acid sequence having at least 95% identity to an amino acid sequence of SEQ ID NO:4384. In one aspect, provided herein is an antibody that binds TRGDC, comprising a heavy chain having an amino acid sequence having at least 95% identity to an amino acid sequence of SEQ ID NO:4385. In one aspect, provided herein is an antibody that binds TRGDC, comprising a light chain having an amino acid sequence having at least 95% identity to an amino acid sequence of SEQ ID NO:4386. In one aspect, provided herein is an antibody that binds TRGDC, comprising a heavy chain having an amino acid sequence having at least 95% identity to an amino acid sequence of SEQ ID NO:4385, and a light chain having an amino acid sequence having at least 95% identity to an amino acid sequence of SEQ ID NO:4386.

In one aspect, provided herein is an antibody that binds TRGDC, comprising: (i) a VH comprising a VH CDR1, a VH CDR2, and a VH CDR3 having an amino acid sequence of SEQ ID NOs:4387, 4388, and 4389, respectively, and (ii) a VL comprising a VL CDR1, VL CDR2, and VL CDR3 having an amino acid sequence of SEQ ID NOs:4390, 4391, and 4392, respectively. In one aspect, provided herein is an antibody that binds TRGDC, comprising: (i) a VH comprising a VH CDR1, a VH CDR2, and a VH CDR3 having an amino acid sequence of SEQ ID NOs:4393, 4394, and 4395, respectively, and (ii) a VL comprising a VL CDR1, VL CDR2, and VL CDR3 having an amino acid sequence of SEQ ID NOs:4396, 4397, and 4398, respectively. In one aspect, provided herein is an antibody that binds TRGDC, comprising: (i) a VH comprising a VH CDR1, a VH CDR2, and a VH CDR3 having an amino acid sequence of SEQ ID NOs:4399, 4400, and 4401, respectively, and (ii) a VL comprising a VL CDR1, VL CDR2, and VL CDR3 having an amino acid sequence of SEQ ID NOs:4402, 4403, and 4404, respectively. In one aspect, provided herein is an antibody that binds TRGDC, comprising: (i) a VH comprising a VH CDR1, a VH CDR2, and a VH CDR3 having an amino acid sequence of SEQ ID NOs:4405, 4406, and 4407, respectively, and (ii) a VL comprising a VL CDR1, VL CDR2, and VL CDR3 having an amino acid sequence of SEQ ID NOs:4408, 4409, and 4410, respectively. In one aspect, provided herein is an antibody that binds TRGDC, comprising: (i) a VH comprising a VH CDR1, a VH CDR2, and a VH CDR3 having an amino acid sequence of SEQ ID NOs:4411, 4412, and 4413, respectively, and (ii) a VL comprising a VL CDR1, VL CDR2, and VL CDR3 having an amino acid sequence of SEQ ID NOs:4414, 4415, and 4416, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4417; and (ii) a VL comprising a VL CDR1, a VL CDR2, and a VL CDR3 having an amino acid sequence of a VL CDR1, a VL CDR2, and a VL CDR3, respectively, of SEQ ID NO:4418. In one aspect, provided herein is an antibody that binds TRGDC, comprising a VH having an amino acid sequence of SEQ ID NO:4417. In one aspect, provided herein is an antibody that binds TRGDC, comprising a VL having an amino acid sequence of SEQ ID NO:4418. In one aspect, provided herein is an antibody that binds TRGDC, comprising a VH having an amino acid sequence of SEQ ID NO:4417, and a VL having an amino acid sequence of SEQ ID NO:4418. In one aspect, provided herein is an antibody that binds TRGDC, comprising a heavy chain having an amino acid sequence of SEQ ID NO:4419. In one aspect, provided herein is an antibody that binds TRGDC, comprising a light chain having an amino acid sequence of SEQ ID NO:4420. In one aspect, provided herein is an antibody that binds TRGDC, comprising a heavy chain having an amino acid sequence of SEQ ID NO:4419, and a light chain having an amino acid sequence of SEQ ID NO:4420. In one aspect, provided herein is an antibody that binds TRGDC, comprising a VH having an amino acid sequence having at least 95% identity to an amino acid sequence of SEQ ID NO:4417. In one aspect, provided herein is an antibody that binds TRGDC, comprising a VL having an amino acid sequence having at least 95% identity to an amino acid sequence of SEQ ID NO:4418. In one aspect, provided herein is an antibody that binds TRGDC, comprising a VH having an amino acid sequence having at least 95% identity to an amino acid sequence of SEQ ID NO:4417, and a VL having an amino acid sequence having at least 95% identity to an amino acid sequence of SEQ ID NO:4418. In one aspect, provided herein is an antibody that binds TRGDC, comprising a heavy chain having an amino acid sequence having at least 95% identity to an amino acid sequence of SEQ ID NO:4419. In one aspect, provided herein is an antibody that binds TRGDC, comprising a light chain having an amino acid sequence having at least 95% identity to an amino acid sequence of SEQ ID NO:4420. In one aspect, provided herein is an antibody that binds TRGDC, comprising a heavy chain having an amino acid sequence having at least 95% identity to an amino acid sequence of SEQ ID NO:4419, and a light chain having an amino acid sequence having at least 95% identity to an amino acid sequence of SEQ ID NO:4420.

In one aspect, provided herein is an antibody that binds TRGDC, comprising: (i) a VH comprising a VH CDR1, a VH CDR2, and a VH CDR3 having an amino acid sequence of SEQ ID NOs:4421, 4422, and 4423, respectively, and (ii) a VL comprising a VL CDR1, VL CDR2, and VL CDR3 having an amino acid sequence of SEQ ID NOs:4424, 4425, and 4426, respectively. In one aspect, provided herein is an antibody that binds TRGDC, comprising: (i) a VH comprising a VH CDR1, a VH CDR2, and a VH CDR3 having an amino acid sequence of SEQ ID NOs:4427, 4428, and 4429, respectively, and (ii) a VL comprising a VL CDR1, VL CDR2, and VL CDR3 having an amino acid sequence of SEQ ID NOs:4430, 4431, and 4432, respectively. In one aspect, provided herein is an antibody that binds TRGDC, comprising: (i) a VH comprising a VH CDR1, a VH CDR2, and a VH CDR3 having an amino acid sequence of SEQ ID NOs:4433, 4434, and 4435, respectively, and (ii) a VL comprising a VL CDR1, VL CDR2, and VL CDR3 having an amino acid sequence of SEQ ID NOs:4436, 4437, and 4438, respectively. In one aspect, provided herein is an antibody that binds TRGDC, comprising: (i) a VH comprising a VH CDR1, a VH CDR2, and a VH CDR3 having an amino acid sequence of SEQ ID NOs:4439, 4440, and 4441, respectively, and (ii) a VL comprising a VL CDR1, VL CDR2, and VL CDR3 having an amino acid sequence of SEQ ID NOs:4442, 4443, and 4444, respectively. In one aspect, provided herein is an antibody that binds TRGDC, comprising: (i) a VH comprising a VH CDR1, a VH CDR2, and a VH CDR3 having an amino acid sequence of SEQ ID NOs:4445, 4446, and 4447, respectively, and (ii) a VL comprising a VL CDR1, VL CDR2, and VL CDR3 having an amino acid sequence of SEQ ID NOs:4448, 4449, and 4450, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4451; and (ii) a VL comprising a VL CDR1, a VL CDR2, and a VL CDR3 having an amino acid sequence of a VL CDR1, a VL CDR2, and a VL CDR3, respectively, of SEQ ID NO:4452. In one aspect, provided herein is an antibody that binds TRGDC, comprising a VH having an amino acid sequence of SEQ ID NO:4451. In one aspect, provided herein is an antibody that binds TRGDC, comprising a VL having an amino acid sequence of SEQ ID NO:4452. In one aspect, provided herein is an antibody that binds TRGDC, comprising a VH having an amino acid sequence of SEQ ID NO:4451, and a VL having an amino acid sequence of SEQ ID NO:4452. In one aspect, provided herein is an antibody that binds TRGDC, comprising a heavy chain having an amino acid sequence of SEQ ID NO:4453. In one aspect, provided herein is an antibody that binds TRGDC, comprising a light chain having an amino acid sequence of SEQ ID NO:4454. In one aspect, provided herein is an antibody that binds TRGDC, comprising a heavy chain having an amino acid sequence of SEQ ID NO:4453, and a light chain having an amino acid sequence of SEQ ID NO:4454. In one aspect, provided herein is an antibody that binds TRGDC, comprising a VH having an amino acid sequence having at least 95% identity to an amino acid sequence of SEQ ID NO:4451. In one aspect, provided herein is an antibody that binds TRGDC, comprising a VL having an amino acid sequence having at least 95% identity to an amino acid sequence of SEQ ID NO:4452. In one aspect, provided herein is an antibody that binds TRGDC, comprising a VH having an amino acid sequence having at least 95% identity to an amino acid sequence of SEQ ID NO:4451, and a VL having an amino acid sequence having at least 95% identity to an amino acid sequence of SEQ ID NO:4452. In one aspect, provided herein is an antibody that binds TRGDC, comprising a heavy chain having an amino acid sequence having at least 95% identity to an amino acid sequence of SEQ ID NO:4453. In one aspect, provided herein is an antibody that binds TRGDC, comprising a light chain having an amino acid sequence having at least 95% identity to an amino acid sequence of SEQ ID NO:4454. In one aspect, provided herein is an antibody that binds TRGDC, comprising a heavy chain having an amino acid sequence having at least 95% identity to an amino acid sequence of SEQ ID NO:4453, and a light chain having an amino acid sequence having at least 95% identity to an amino acid sequence of SEQ ID NO:4454.

In one aspect, provided herein is an antibody that binds TRGDC, comprising: (i) a VH comprising a VH CDR1, a VH CDR2, and a VH CDR3 having an amino acid sequence of SEQ ID NOs:4455, 4456, and 4457, respectively, and (ii) a VL comprising a VL CDR1, VL CDR2, and VL CDR3 having an amino acid sequence of SEQ ID NOs:4458, 4459, and 4460, respectively. In one aspect, provided herein is an antibody that binds TRGDC, comprising: (i) a VH comprising a VH CDR1, a VH CDR2, and a VH CDR3 having an amino acid sequence of SEQ ID NOs:4461, 4462, and 4463, respectively, and (ii) a VL comprising a VL CDR1, VL CDR2, and VL CDR3 having an amino acid sequence of SEQ ID NOs:4464, 4465, and 4466, respectively. In one aspect, provided herein is an antibody that binds TRGDC, comprising: (i) a VH comprising a VH CDR1, a VH CDR2, and a VH CDR3 having an amino acid sequence of SEQ ID NOs:4467, 4468, and 4469, respectively, and (ii) a VL comprising a VL CDR1, VL CDR2, and VL CDR3 having an amino acid sequence of SEQ ID NOs:4470, 4471, and 4472, respectively. In one aspect, provided herein is an antibody that binds TRGDC, comprising: (i) a VH comprising a VH CDR1, a VH CDR2, and a VH CDR3 having an amino acid sequence of SEQ ID NOs:4473, 4474, and 4475, respectively, and (ii) a VL comprising a VL CDR1, VL CDR2, and VL CDR3 having an amino acid sequence of SEQ ID NOs:4476, 4477, and 4478, respectively. In one aspect, provided herein is an antibody that binds TRGDC, comprising: (i) a VH comprising a VH CDR1, a VH CDR2, and a VH CDR3 having an amino acid sequence of SEQ ID NOs:4479, 4480, and 4481, respectively, and (ii) a VL comprising a VL CDR1, VL CDR2, and VL CDR3 having an amino acid sequence of SEQ ID NOs:4482, 4483, and 4484, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4485; and (ii) a VL comprising a VL CDR1, a VL CDR2, and a VL CDR3 having an amino acid sequence of a VL CDR1, a VL CDR2, and a VL CDR3, respectively, of SEQ ID NO:4486. In one aspect, provided herein is an antibody that binds TRGDC, comprising a VH having an amino acid sequence of SEQ ID NO:4485. In one aspect, provided herein is an antibody that binds TRGDC, comprising a VL having an amino acid sequence of SEQ ID NO:4486. In one aspect, provided herein is an antibody that binds TRGDC, comprising a VH having an amino acid sequence of SEQ ID NO:4485, and a VL having an amino acid sequence of SEQ ID NO:4486. In one aspect, provided herein is an antibody that binds TRGDC, comprising a heavy chain having an amino acid sequence of SEQ ID NO:4487. In one aspect, provided herein is an antibody that binds TRGDC, comprising a light chain having an amino acid sequence of SEQ ID NO:4488. In one aspect, provided herein is an antibody that binds TRGDC, comprising a heavy chain having an amino acid sequence of SEQ ID NO:4487, and a light chain having an amino acid sequence of SEQ ID NO:4488. In one aspect, provided herein is an antibody that binds TRGDC, comprising a VH having an amino acid sequence having at least 95% identity to an amino acid sequence of SEQ ID NO:4485. In one aspect, provided herein is an antibody that binds TRGDC, comprising a VL having an amino acid sequence having at least 95% identity to an amino acid sequence of SEQ ID NO:4486. In one aspect, provided herein is an antibody that binds TRGDC, comprising a VH having an amino acid sequence having at least 95% identity to an amino acid sequence of SEQ ID NO:4485, and a VL having an amino acid sequence having at least 95% identity to an amino acid sequence of SEQ ID NO:4486. In one aspect, provided herein is an antibody that binds TRGDC, comprising a heavy chain having an amino acid sequence having at least 95% identity to an amino acid sequence of SEQ ID NO:4487. In one aspect, provided herein is an antibody that binds TRGDC, comprising a light chain having an amino acid sequence having at least 95% identity to an amino acid sequence of SEQ ID NO:4488. In one aspect, provided herein is an antibody that binds TRGDC, comprising a heavy chain having an amino acid sequence having at least 95% identity to an amino acid sequence of SEQ ID NO:4487, and a light chain having an amino acid sequence having at least 95% identity to an amino acid sequence of SEQ ID NO:4488.

In one aspect, provided herein is an antibody that binds TRGDC, comprising: (i) a VH comprising a VH CDR1, a VH CDR2, and a VH CDR3 having an amino acid sequence of SEQ ID NOs:4489, 4490, and 4491, respectively, and (ii) a VL comprising a VL CDR1, VL CDR2, and VL CDR3 having an amino acid sequence of SEQ ID NOs:4492, 4493, and 4494, respectively. In one aspect, provided herein is an antibody that binds TRGDC, comprising: (i) a VH comprising a VH CDR1, a VH CDR2, and a VH CDR3 having an amino acid sequence of SEQ ID NOs:4495, 4496, and 4497, respectively, and (ii) a VL comprising a VL CDR1, VL CDR2, and VL CDR3 having an amino acid sequence of SEQ ID NOs:4498, 4499, and 4500, respectively. In one aspect, provided herein is an antibody that binds TRGDC, comprising: (i) a VH comprising a VH CDR1, a VH CDR2, and a VH CDR3 having an amino acid sequence of SEQ ID NOs:4501, 4502, and 4503, respectively, and (ii) a VL comprising a VL CDR1, VL CDR2, and VL CDR3 having an amino acid sequence of SEQ ID NOs:4504, 4505, and 4506, respectively. In one aspect, provided herein is an antibody that binds TRGDC, comprising: (i) a VH comprising a VH CDR1, a VH CDR2, and a VH CDR3 having an amino acid sequence of SEQ ID NOs:4507, 4508, and 4509, respectively, and (ii) a VL comprising a VL CDR1, VL CDR2, and VL CDR3 having an amino acid sequence of SEQ ID NOs:4510, 4511, and 4512, respectively. In one aspect, provided herein is an antibody that binds TRGDC, comprising: (i) a VH comprising a VH CDR1, a VH CDR2, and a VH CDR3 having an amino acid sequence of SEQ ID NOs:4513, 4514, and 4515, respectively, and (ii) a VL comprising a VL CDR1, VL CDR2, and VL CDR3 having an amino acid sequence of SEQ ID NOs:4516, 4517, and 4518, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4519; and (ii) a VL comprising a VL CDR1, a VL CDR2, and a VL CDR3 having an amino acid sequence of a VL CDR1, a VL CDR2, and a VL CDR3, respectively, of SEQ ID NO:4520. In one aspect, provided herein is an antibody that binds TRGDC, comprising a VH having an amino acid sequence of SEQ ID NO:4519. In one aspect, provided herein is an antibody that binds TRGDC, comprising a VL having an amino acid sequence of SEQ ID NO:4520. In one aspect, provided herein is an antibody that binds TRGDC, comprising a VH having an amino acid sequence of SEQ ID NO:4519, and a VL having an amino acid sequence of SEQ ID NO:4520. In one aspect, provided herein is an antibody that binds TRGDC, comprising a heavy chain having an amino acid sequence of SEQ ID NO:4521. In one aspect, provided herein is an antibody that binds TRGDC, comprising a light chain having an amino acid sequence of SEQ ID NO:4522. In one aspect, provided herein is an antibody that binds TRGDC, comprising a heavy chain having an amino acid sequence of SEQ ID NO:4521, and a light chain having an amino acid sequence of SEQ ID NO:4522. In one aspect, provided herein is an antibody that binds TRGDC, comprising a VH having an amino acid sequence having at least 95% identity to an amino acid sequence of SEQ ID NO:4519. In one aspect, provided herein is an antibody that binds TRGDC, comprising a VL having an amino acid sequence having at least 95% identity to an amino acid sequence of SEQ ID NO:4520. In one aspect, provided herein is an antibody that binds TRGDC, comprising a VH having an amino acid sequence having at least 95% identity to an amino acid sequence of SEQ ID NO:4519, and a VL having an amino acid sequence having at least 95% identity to an amino acid sequence of SEQ ID NO:4520. In one aspect, provided herein is an antibody that binds TRGDC, comprising a heavy chain having an amino acid sequence having at least 95% identity to an amino acid sequence of SEQ ID NO:4521. In one aspect, provided herein is an antibody that binds TRGDC, comprising a light chain having an amino acid sequence having at least 95% identity to an amino acid sequence of SEQ ID NO:4522. In one aspect, provided herein is an antibody that binds TRGDC, comprising a heavy chain having an amino acid sequence having at least 95% identity to an amino acid sequence of SEQ ID NO:4521, and a light chain having an amino acid sequence having at least 95% identity to an amino acid sequence of SEQ ID NO:4522.

In one aspect, provided herein is an antibody that binds TRGDC, comprising: (i) a VH comprising a VH CDR1, a VH CDR2, and a VH CDR3 having an amino acid sequence of SEQ ID NOs:4523, 4524, and 4525, respectively, and (ii) a VL comprising a VL CDR1, VL CDR2, and VL CDR3 having an amino acid sequence of SEQ ID NOs:4526, 4527, and 4528, respectively. In one aspect, provided herein is an antibody that binds TRGDC, comprising: (i) a VH comprising a VH CDR1, a VH CDR2, and a VH CDR3 having an amino acid sequence of SEQ ID NOs:4529, 4530, and 4531, respectively, and (ii) a VL comprising a VL CDR1, VL CDR2, and VL CDR3 having an amino acid sequence of SEQ ID NOs:4532, 4533, and 4534, respectively. In one aspect, provided herein is an antibody that binds TRGDC, comprising: (i) a VH comprising a VH CDR1, a VH CDR2, and a VH CDR3 having an amino acid sequence of SEQ ID NOs:4535, 4536, and 4537, respectively, and (ii) a VL comprising a VL CDR1, VL CDR2, and VL CDR3 having an amino acid sequence of SEQ ID NOs:4538, 4539, and 4540, respectively. In one aspect, provided herein is an antibody that binds TRGDC, comprising: (i) a VH comprising a VH CDR1, a VH CDR2, and a VH CDR3 having an amino acid sequence of SEQ ID NOs:4541, 4542, and 4543, respectively, and (ii) a VL comprising a VL CDR1, VL CDR2, and VL CDR3 having an amino acid sequence of SEQ ID NOs:4544, 4545, and 4546, respectively. In one aspect, provided herein is an antibody that binds TRGDC, comprising: (i) a VH comprising a VH CDR1, a VH CDR2, and a VH CDR3 having an amino acid sequence of SEQ ID NOs:4547, 4548, and 4549, respectively, and (ii) a VL comprising a VL CDR1, VL CDR2, and VL CDR3 having an amino acid sequence of SEQ ID NOs:4550, 4551, and 4552, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4553; and (ii) a VL comprising a VL CDR1, a VL CDR2, and a VL CDR3 having an amino acid sequence of a VL CDR1, a VL CDR2, and a VL CDR3, respectively, of SEQ ID NO:4554. In one aspect, provided herein is an antibody that binds TRGDC, comprising a VH having an amino acid sequence of SEQ ID NO:4553. In one aspect, provided herein is an antibody that binds TRGDC, comprising a VL having an amino acid sequence of SEQ ID NO:4554. In one aspect, provided herein is an antibody that binds TRGDC, comprising a VH having an amino acid sequence of SEQ ID NO:4553, and a VL having an amino acid sequence of SEQ ID NO:4554. In one aspect, provided herein is an antibody that binds TRGDC, comprising a heavy chain having an amino acid sequence of SEQ ID NO:4555. In one aspect, provided herein is an antibody that binds TRGDC, comprising a light chain having an amino acid sequence of SEQ ID NO:4556. In one aspect, provided herein is an antibody that binds TRGDC, comprising a heavy chain having an amino acid sequence of SEQ ID NO:4555, and a light chain having an amino acid sequence of SEQ ID NO:4556. In one aspect, provided herein is an antibody that binds TRGDC, comprising a VH having an amino acid sequence having at least 95% identity to an amino acid sequence of SEQ ID NO:4553. In one aspect, provided herein is an antibody that binds TRGDC, comprising a VL having an amino acid sequence having at least 95% identity to an amino acid sequence of SEQ ID NO:4554. In one aspect, provided herein is an antibody that binds TRGDC, comprising a VH having an amino acid sequence having at least 95% identity to an amino acid sequence of SEQ ID NO:4553, and a VL having an amino acid sequence having at least 95% identity to an amino acid sequence of SEQ ID NO:4554. In one aspect, provided herein is an antibody that binds TRGDC, comprising a heavy chain having an amino acid sequence having at least 95% identity to an amino acid sequence of SEQ ID NO:4555. In one aspect, provided herein is an antibody that binds TRGDC, comprising a light chain having an amino acid sequence having at least 95% identity to an amino acid sequence of SEQ ID NO:4556. In one aspect, provided herein is an antibody that binds TRGDC, comprising a heavy chain having an amino acid sequence having at least 95% identity to an amino acid sequence of SEQ ID NO:4555, and a light chain having an amino acid sequence having at least 95% identity to an amino acid sequence of SEQ ID NO:4556.

In one aspect, provided herein is an antibody that binds TRGDC, comprising: (i) a VH comprising a VH CDR1, a VH CDR2, and a VH CDR3 having an amino acid sequence of SEQ ID NOs:4557, 4558, and 4559, respectively, and (ii) a VL comprising a VL CDR1, VL CDR2, and VL CDR3 having an amino acid sequence of SEQ ID NOs:4560, 4561, and 4562, respectively. In one aspect, provided herein is an antibody that binds TRGDC, comprising: (i) a VH comprising a VH CDR1, a VH CDR2, and a VH CDR3 having an amino acid sequence of SEQ ID NOs:4563, 4564, and 4565, respectively, and (ii) a VL comprising a VL CDR1, VL CDR2, and VL CDR3 having an amino acid sequence of SEQ ID NOs:4566, 4567, and 4568, respectively. In one aspect, provided herein is an antibody that binds TRGDC, comprising: (i) a VH comprising a VH CDR1, a VH CDR2, and a VH CDR3 having an amino acid sequence of SEQ ID NOs:4569, 4570, and 4571, respectively, and (ii) a VL comprising a VL CDR1, VL CDR2, and VL CDR3 having an amino acid sequence of SEQ ID NOs:4572, 4573, and 4574, respectively. In one aspect, provided herein is an antibody that binds TRGDC, comprising: (i) a VH comprising a VH CDR1, a VH CDR2, and a VH CDR3 having an amino acid sequence of SEQ ID NOs:4575, 4576, and 4577, respectively, and (ii) a VL comprising a VL CDR1, VL CDR2, and VL CDR3 having an amino acid sequence of SEQ ID NOs:4578, 4579, and 4580, respectively. In one aspect, provided herein is an antibody that binds TRGDC, comprising: (i) a VH comprising a VH CDR1, a VH CDR2, and a VH CDR3 having an amino acid sequence of SEQ ID NOs:4581, 4582, and 4583, respectively, and (ii) a VL comprising a VL CDR1, VL CDR2, and VL CDR3 having an amino acid sequence of SEQ ID NOs:4584, 4585, and 4586, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4587; and (ii) a VL comprising a VL CDR1, a VL CDR2, and a VL CDR3 having an amino acid sequence of a VL CDR1, a VL CDR2, and a VL CDR3, respectively, of SEQ ID NO:4588. In one aspect, provided herein is an antibody that binds TRGDC, comprising a VH having an amino acid sequence of SEQ ID NO:4587. In one aspect, provided herein is an antibody that binds TRGDC, comprising a VL having an amino acid sequence of SEQ ID NO:4588. In one aspect, provided herein is an antibody that binds TRGDC, comprising a VH having an amino acid sequence of SEQ ID NO:4587, and a VL having an amino acid sequence of SEQ ID NO:4588. In one aspect, provided herein is an antibody that binds TRGDC, comprising a heavy chain having an amino acid sequence of SEQ ID NO:4589. In one aspect, provided herein is an antibody that binds TRGDC, comprising a light chain having an amino acid sequence of SEQ ID NO:4590. In one aspect, provided herein is an antibody that binds TRGDC, comprising a heavy chain having an amino acid sequence of SEQ ID NO:4589, and a light chain having an amino acid sequence of SEQ ID NO:4590. In one aspect, provided herein is an antibody that binds TRGDC, comprising a VH having an amino acid sequence having at least 95% identity to an amino acid sequence of SEQ ID NO:4587. In one aspect, provided herein is an antibody that binds TRGDC, comprising a VL having an amino acid sequence having at least 95% identity to an amino acid sequence of SEQ ID NO:4588. In one aspect, provided herein is an antibody that binds TRGDC, comprising a VH having an amino acid sequence having at least 95% identity to an amino acid sequence of SEQ ID NO:4587, and a VL having an amino acid sequence having at least 95% identity to an amino acid sequence of SEQ ID NO:4588. In one aspect, provided herein is an antibody that binds TRGDC, comprising a heavy chain having an amino acid sequence having at least 95% identity to an amino acid sequence of SEQ ID NO:4589. In one aspect, provided herein is an antibody that binds TRGDC, comprising a light chain having an amino acid sequence having at least 95% identity to an amino acid sequence of SEQ ID NO:4590. In one aspect, provided herein is an antibody that binds TRGDC, comprising a heavy chain having an amino acid sequence having at least 95% identity to an amino acid sequence of SEQ ID NO:4589, and a light chain having an amino acid sequence having at least 95% identity to an amino acid sequence of SEQ ID NO:4590.

In one aspect, provided herein is an antibody that binds TRGDC, comprising: (i) a VH comprising a VH CDR1, a VH CDR2, and a VH CDR3 having an amino acid sequence of SEQ ID NOs:4591, 4592, and 4593, respectively, and (ii) a VL comprising a VL CDR1, VL CDR2, and VL CDR3 having an amino acid sequence of SEQ ID NOs:4594, 4595, and 4596, respectively. In one aspect, provided herein is an antibody that binds TRGDC, comprising: (i) a VH comprising a VH CDR1, a VH CDR2, and a VH CDR3 having an amino acid sequence of SEQ ID NOs:4597, 4598, and 4599, respectively, and (ii) a VL comprising a VL CDR1, VL CDR2, and VL CDR3 having an amino acid sequence of SEQ ID NOs:4600, 4601, and 4602, respectively. In one aspect, provided herein is an antibody that binds TRGDC, comprising: (i) a VH comprising a VH CDR1, a VH CDR2, and a VH CDR3 having an amino acid sequence of SEQ ID NOs:4603, 4604, and 4605, respectively, and (ii) a VL comprising a VL CDR1, VL CDR2, and VL CDR3 having an amino acid sequence of SEQ ID NOs:4606, 4607, and 4608, respectively. In one aspect, provided herein is an antibody that binds TRGDC, comprising: (i) a VH comprising a VH CDR1, a VH CDR2, and a VH CDR3 having an amino acid sequence of SEQ ID NOs:4609, 4610, and 4611, respectively, and (ii) a VL comprising a VL CDR1, VL CDR2, and VL CDR3 having an amino acid sequence of SEQ ID NOs:4612, 4613, and 4614, respectively. In one aspect, provided herein is an antibody that binds TRGDC, comprising: (i) a VH comprising a VH CDR1, a VH CDR2, and a VH CDR3 having an amino acid sequence of SEQ ID NOs:4615, 4616, and 4617, respectively, and (ii) a VL comprising a VL CDR1, VL CDR2, and VL CDR3 having an amino acid sequence of SEQ ID NOs:4618, 4619, and 4620, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4621; and (ii) a VL comprising a VL CDR1, a VL CDR2, and a VL CDR3 having an amino acid sequence of a VL CDR1, a VL CDR2, and a VL CDR3, respectively, of SEQ ID NO:4622. In one aspect, provided herein is an antibody that binds TRGDC, comprising a VH having an amino acid sequence of SEQ ID NO:4621. In one aspect, provided herein is an antibody that binds TRGDC, comprising a VL having an amino acid sequence of SEQ ID NO:4622. In one aspect, provided herein is an antibody that binds TRGDC, comprising a VH having an amino acid sequence of SEQ ID NO:4621, and a VL having an amino acid sequence of SEQ ID NO:4622. In one aspect, provided herein is an antibody that binds TRGDC, comprising a heavy chain having an amino acid sequence of SEQ ID NO:4623. In one aspect, provided herein is an antibody that binds TRGDC, comprising a light chain having an amino acid sequence of SEQ ID NO:4624. In one aspect, provided herein is an antibody that binds TRGDC, comprising a heavy chain having an amino acid sequence of SEQ ID NO:4623, and a light chain having an amino acid sequence of SEQ ID NO:4624. In one aspect, provided herein is an antibody that binds TRGDC, comprising a VH having an amino acid sequence having at least 95% identity to an amino acid sequence of SEQ ID NO:4621. In one aspect, provided herein is an antibody that binds TRGDC, comprising a VL having an amino acid sequence having at least 95% identity to an amino acid sequence of SEQ ID NO:4622. In one aspect, provided herein is an antibody that binds TRGDC, comprising a VH having an amino acid sequence having at least 95% identity to an amino acid sequence of SEQ ID NO:4621, and a VL having an amino acid sequence having at least 95% identity to an amino acid sequence of SEQ ID NO:4622. In one aspect, provided herein is an antibody that binds TRGDC, comprising a heavy chain having an amino acid sequence having at least 95% identity to an amino acid sequence of SEQ ID NO:4623. In one aspect, provided herein is an antibody that binds TRGDC, comprising a light chain having an amino acid sequence having at least 95% identity to an amino acid sequence of SEQ ID NO:4624. In one aspect, provided herein is an antibody that binds TRGDC, comprising a heavy chain having an amino acid sequence having at least 95% identity to an amino acid sequence of SEQ ID NO:4623, and a light chain having an amino acid sequence having at least 95% identity to an amino acid sequence of SEQ ID NO:4624.

In one aspect, provided herein is an antibody that binds TRGDC, comprising: (i) a VH comprising a VH CDR1, a VH CDR2, and a VH CDR3 having an amino acid sequence of SEQ ID NOs:4625, 4626, and 4627, respectively, and (ii) a VL comprising a VL CDR1, VL CDR2, and VL CDR3 having an amino acid sequence of SEQ ID NOs:4628, 4629, and 4630, respectively. In one aspect, provided herein is an antibody that binds TRGDC, comprising: (i) a VH comprising a VH CDR1, a VH CDR2, and a VH CDR3 having an amino acid sequence of SEQ ID NOs:4631, 4632, and 4633, respectively, and (ii) a VL comprising a VL CDR1, VL CDR2, and VL CDR3 having an amino acid sequence of SEQ ID NOs:4634, 4635, and 4636, respectively. In one aspect, provided herein is an antibody that binds TRGDC, comprising: (i) a VH comprising a VH CDR1, a VH CDR2, and a VH CDR3 having an amino acid sequence of SEQ ID NOs:4637, 4638, and 4639, respectively, and (ii) a VL comprising a VL CDR1, VL CDR2, and VL CDR3 having an amino acid sequence of SEQ ID NOs:4640, 4641, and 4642, respectively. In one aspect, provided herein is an antibody that binds TRGDC, comprising: (i) a VH comprising a VH CDR1, a VH CDR2, and a VH CDR3 having an amino acid sequence of SEQ ID NOs:4643, 4644, and 4645, respectively, and (ii) a VL comprising a VL CDR1, VL CDR2, and VL CDR3 having an amino acid sequence of SEQ ID NOs:4646, 4647, and 4648, respectively. In one aspect, provided herein is an antibody that binds TRGDC, comprising: (i) a VH comprising a VH CDR1, a VH CDR2, and a VH CDR3 having an amino acid sequence of SEQ ID NOs:4649, 4650, and 4651, respectively, and (ii) a VL comprising a VL CDR1, VL CDR2, and VL CDR3 having an amino acid sequence of SEQ ID NOs:4652, 4653, and 4654, respectively. In one aspect, provided herein is an antibody that binds TRGDC, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4655; and (ii) a VL comprising a VL CDR1, a VL CDR2, and a VL CDR3 having an amino acid sequence of a VL CDR1, a VL CDR2, and a VL CDR3, respectively, of SEQ ID NO:4656. In one aspect, provided herein is an antibody that binds TRGDC, comprising a VH having an amino acid sequence of SEQ ID NO:4655. In one aspect, provided herein is an antibody that binds TRGDC, comprising a VL having an amino acid sequence of SEQ ID NO:4656. In one aspect, provided herein is an antibody that binds TRGDC, comprising a VH having an amino acid sequence of SEQ ID NO:4655, and a VL having an amino acid sequence of SEQ ID NO:4656. In one aspect, provided herein is an antibody that binds TRGDC, comprising a heavy chain having an amino acid sequence of SEQ ID NO:4657. In one aspect, provided herein is an antibody that binds TRGDC, comprising a light chain having an amino acid sequence of SEQ ID NO:4658. In one aspect, provided herein is an antibody that binds TRGDC, comprising a heavy chain having an amino acid sequence of SEQ ID NO:4657, and a light chain having an amino acid sequence of SEQ ID NO:4658. In one aspect, provided herein is an antibody that binds TRGDC, comprising a VH having an amino acid sequence having at least 95% identity to an amino acid sequence of SEQ ID NO:4655. In one aspect, provided herein is an antibody that binds TRGDC, comprising a VL having an amino acid sequence having at least 95% identity to an amino acid sequence of SEQ ID NO:4656. In one aspect, provided herein is an antibody that binds TRGDC, comprising a VH having an amino acid sequence having at least 95% identity to an amino acid sequence of SEQ ID NO:4655, and a VL having an amino acid sequence having at least 95% identity to an amino acid sequence of SEQ ID NO:4656. In one aspect, provided herein is an antibody that binds TRGDC, comprising a heavy chain having an amino acid sequence having at least 95% identity to an amino acid sequence of SEQ ID NO:4657. In one aspect, provided herein is an antibody that binds TRGDC, comprising a light chain having an amino acid sequence having at least 95% identity to an amino acid sequence of SEQ ID NO:4658. In one aspect, provided herein is an antibody that binds TRGDC, comprising a heavy chain having an amino acid sequence having at least 95% identity to an amino acid sequence of SEQ ID NO:4657, and a light chain having an amino acid sequence having at least 95% identity to an amino acid sequence of SEQ ID NO:4658.

In one aspect, provided herein is an antibody that binds TRGDC. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4145. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4146. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4145; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4146. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4179. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4180. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4179; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4180. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4213. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4214. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4213; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4214. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4247. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4248. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4247; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4248. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4281. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4282. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4281; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4282. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4315. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4316. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4315; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4316. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4349. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4350. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4349; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4350. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4383. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4384. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4383; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4384. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4417. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4418. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4417; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4418. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4451. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4452. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4451; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4452. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4485. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4486. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4485; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4486. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4519. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4520. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4519; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4520. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4553. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4554. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4553; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4554. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4587. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4588. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4587; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4588. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4621. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4622. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4621; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4622. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4655. In one embodiment, the TRGDC antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4656. In one embodiment, the TRGDC antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4655; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4656. In some embodiments, the TRGDC antibody is a multispecific antibody. In some embodiments, the TRGDC antibody is a bispecific antibody. In some embodiments, the TRGDC antibody is a trispecific antibody. In some embodiments, the TRGDC antibody is a quadraspecific antibody.

In one aspect, provided herein is an antibody that binds TRGDC, comprising a VH CDR1 having an amino acid sequence of SEQ ID NO:4139, wherein the eighth amino acid is R or S; a VH CDR2 having an amino acid sequence of SEQ ID NO:4140; a VH CDR3 having an amino acid sequence of SEQ ID NO:4141, wherein the third amino acid is D or G, the fourth amino acid is E or L, the sixth amino acid is E or G, the ninth amino acid is E or D, the eleventh amino acid is C or F. In one aspect, provided herein is an antibody that binds TRGDC, comprising a VL CDR1 having an amino acid sequence of SEQ ID NO:4142, wherein the fourth amino acid is H or S; a VL CDR2 having an amino acid sequence of SEQ ID NO:4143; and a VL CDR3 having an amino acid sequence of SEQ ID NO:4144, wherein the eighth amino acid is F or W. In one aspect, provided herein is an antibody that binds TRGDC, comprising a VH CDR1 having an amino acid sequence of SEQ ID NO:4139, wherein the eighth amino acid is R or S; a VH CDR2 having an amino acid sequence of SEQ ID NO:4140; a VH CDR3 having an amino acid sequence of SEQ ID NO:4141, wherein the third amino acid is D or G, the fourth amino acid is E or L, the sixth amino acid is E or G, the ninth amino acid is E or D, the eleventh amino acid is C or F; a VL CDR1 having an amino acid sequence of SEQ ID NO:4142, wherein the fourth amino acid is H or S; a VL CDR2 having an amino acid sequence of SEQ ID NO:4143; and a VL CDR3 having an amino acid sequence of SEQ ID NO:4144, wherein the eighth amino acid is F or W.

In one aspect, provided herein is an antibody that binds TRGDC, comprising a VH CDR1 having an amino acid sequence of SEQ ID NO:4173, wherein the first amino acid is G or R, the fourth amino acid is F or L, the sixth amino acid is N or S; a VH CDR2 having an amino acid sequence of SEQ ID NO:4174; a VH CDR3 having an amino acid sequence of SEQ ID NO:4175, wherein the fourth amino acid is R or V, the seventh amino acid is G or T, the eighth amino acid is G or T, there is no ninth amino acid or is T, the sixteenth amino acid is L or M. In one aspect, provided herein is an antibody that binds TRGDC, comprising a VL CDR1 having an amino acid sequence of SEQ ID NO:4176, wherein the fourth amino acid is A or S; a VL CDR2 having an amino acid sequence of SEQ ID NO:4177; and a VL CDR3 having an amino acid sequence of SEQ ID NO:4178. In one aspect, provided herein is an antibody that binds TRGDC, comprising a VH CDR1 having an amino acid sequence of SEQ ID NO:4173, wherein the first amino acid is G or R, the fourth amino acid is F or L, the sixth amino acid is N or S; a VH CDR2 having an amino acid sequence of SEQ ID NO:4174; a VH CDR3 having an amino acid sequence of SEQ ID NO:4175, wherein the fourth amino acid is R or V, the seventh amino acid is G or T, the eighth amino acid is G or T, there is no ninth amino acid or is T, the sixteenth amino acid is L or M; a VL CDR1 having an amino acid sequence of SEQ ID NO:4176, wherein the fourth amino acid is A or S; a VL CDR2 having an amino acid sequence of SEQ ID NO:4177; and a VL CDR3 having an amino acid sequence of SEQ ID NO:4178.

In one aspect, provided herein is an antibody that binds TRGDC, comprising a VH CDR1 having an amino acid sequence of SEQ ID NO:4479, wherein the third amino acid is S or T, the sixth amino acid is N or S; a VH CDR2 having an amino acid sequence of SEQ ID NO:4480, wherein the fourth amino acid is I or F, the sixth amino acid is G or S, the seventh amino acid is A or T, the eighth amino acid is A, G, or P; a VH CDR3 having an amino acid sequence of SEQ ID NO:4481, wherein the first amino acid is S or no amino acid in this position, the second amino acid is S, T, or no amino acid in this position, the third amino acid is A, G, or S, the fourth amino acid is G, N, or T, the fifth amino acid is A, G, or S, the sixth amino acid is G, T, or Y, the seventh amino acid is G, T, or V, the eighth amino acid is D, T, or Y, the ninth amino acid is T or Y, the fifteenth amino acid is I or M, the sixteenth amino acid is D or N. In one aspect, provided herein is an antibody that binds TRGDC, comprising a VL CDR1 having an amino acid sequence of SEQ ID NO:4482; a VL CDR2 having an amino acid sequence of SEQ ID NO:4483, wherein the first amino acid is E or K, the third amino acid is F or S; and a VL CDR3 having an amino acid sequence of SEQ ID NO:4484, wherein the fifth amino acid is E or Q. In one aspect, provided herein is an antibody that binds TRGDC, comprising a VH CDR1 having an amino acid sequence of SEQ ID NO:4479, wherein the third amino acid is S or T, the sixth amino acid is N or S; a VH CDR2 having an amino acid sequence of SEQ ID NO:4480, wherein the fourth amino acid is I or F, the sixth amino acid is G or S, the seventh amino acid is A or T, the eighth amino acid is A, G, or P; a VH CDR3 having an amino acid sequence of SEQ ID NO:4481, wherein the first amino acid is S or no amino acid in this position, the second amino acid is S, T, or no amino acid in this position, the third amino acid is A, G, or S, the fourth amino acid is G, N, or T, the fifth amino acid is A, G, or S, the sixth amino acid is G, T, or Y, the seventh amino acid is G, T, or V, the eighth amino acid is D, T, or Y, the ninth amino acid is T or Y, the fifteenth amino acid is I or M, the sixteenth amino acid is D or N; a VL CDR1 having an amino acid sequence of SEQ ID NO:4482; a VL CDR2 having an amino acid sequence of SEQ ID NO:4483, wherein the first amino acid is E or K, the third amino acid is F or S; and a VL CDR3 having an amino acid sequence of SEQ ID NO:4484, wherein the fifth amino acid is E or Q.

In one aspect, provided herein is an antibody that binds TRGDC, comprising a VH CDR1 having an amino acid sequence of SEQ ID NO:4241; a VH CDR2 having an amino acid sequence of SEQ ID NO:4242, wherein the seventh amino acid is A or Y; a VH CDR3 having an amino acid sequence of SEQ ID NO:4243, wherein the third amino acid is E or L, the ninth amino acid is I or V. In one aspect, provided herein is an antibody that binds TRGDC, comprising a VL CDR1 having an amino acid sequence of SEQ ID NO:4244, wherein the first amino acid is N or S, the fourth amino acid is N or S; a VL CDR2 having an amino acid sequence of SEQ ID NO:4245; and a VL CDR3 having an amino acid sequence of SEQ ID NO:4246, wherein the fifth amino acid is N or S, the tenth amino acid is V or W. In one aspect, provided herein is an antibody that binds TRGDC, comprising a VH CDR1 having an amino acid sequence of SEQ ID NO:4241; a VH CDR2 having an amino acid sequence of SEQ ID NO:4242, wherein the seventh amino acid is A or Y; a VH CDR3 having an amino acid sequence of SEQ ID NO:4243, wherein the third amino acid is E or L, the ninth amino acid is I or V; a VL CDR1 having an amino acid sequence of SEQ ID NO:4244, wherein the first amino acid is N or S, the fourth amino acid is N or S; a VL CDR2 having an amino acid sequence of SEQ ID NO:4245; and a VL CDR3 having an amino acid sequence of SEQ ID NO:4246, wherein the fifth amino acid is N or S, the tenth amino acid is V or W.

In another aspect, provided herein is a multispecific antibody that binds TRGV9. In some embodiments, the multispecific antibody is a bispecific antibody. In some embodiments, the multispecific antibody is a trispecific antibody. In some embodiments, the multispecific antibody is a quadraspecific antibody. In one embodiment, the multispecific TRGV9 antibody comprises: (a) a first binding domain that binds TRGV9, and (b) a second binding domain that binds to a second target. In one embodiment, the multispecific TRGV9 antibody comprises: (a) a first binding domain that binds TRGV9, and (b) a second binding domain that binds to a second target, and (c) a third binding domain that binds to a third target. In one embodiment, the multispecific TRGV9 antibody comprises: (a) a first binding domain that binds TRGV9, and (b) a second binding domain that binds to a second target, (c) a third binding domain that binds to a third target, and (d) a fourth binding domain that binds to a fourth target.

In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780.

In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003. In one embodiment, the first binding domain that binds TRGV9 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004. In one embodiment, the first binding domain that binds TRGV9 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004.

In another aspect, provided herein is a multispecific antibody that binds TRDV2. In some embodiments, the multispecific antibody is a bispecific antibody. In some embodiments, the multispecific antibody is a trispecific antibody. In some embodiments, the multispecific antibody is a quadraspecific antibody. In one embodiment, the multispecific TRDV2 antibody comprises: (a) a first binding domain that binds TRDV2, and (b) a second binding domain that binds to a second target. In one embodiment, the multispecific TRDV2 antibody comprises: (a) a first binding domain that binds TRDV2, and (b) a second binding domain that binds to a second target, and (c) a third binding domain that binds to a third target. In one embodiment, the multispecific TRDV2 antibody comprises: (a) a first binding domain that binds TRDV2, and (b) a second binding domain that binds to a second target, (c) a third binding domain that binds to a third target, and (d) a fourth binding domain that binds to a fourth target.

In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2207. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2208. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2207; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2208. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2241. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2242. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2241; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2242. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2275. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2276. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2275; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2276. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2309. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2310. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2309; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2310. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2343. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2344. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2343; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2344. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2377. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2378. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2377; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2378. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2411. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2412. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2411; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2412. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2445. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2446. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2445; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2446. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2479. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2480. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2479; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2480. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2513. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2514. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2513; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2514. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2547. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2548. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2547; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2548. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2581. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2582. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2581; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2582. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2615. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2616. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2615; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2616. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2649. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2650. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2649; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2650. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2683. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2684. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2683; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2684. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2717. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2718.

In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2717; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2718. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2751. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2752. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2751; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2752. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2785. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2786. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2785; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2786. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2819. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2820. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2819; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2820. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2853. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2854. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2853; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2854. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2887. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2888. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2887; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2888. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2921. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2922. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2921; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2922. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2955. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2956. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2955; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2956. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2989. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2990. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2989; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2990. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3023. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3024. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3023; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3024. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3057. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3058. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3057; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3058. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3091. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3092. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3091; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3092. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3125. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3126. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3125; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3126. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3159. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3160. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3159; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3160. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3193. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3194. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3193; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3194. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3227. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3228. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3227; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3228. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3261. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3262. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3261; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3262. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3295. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3296. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3295; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3296. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3329. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3330. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3329; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3330. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3363. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3364. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3363; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3364. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3397. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3398. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3397; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3398. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3431. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3432. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3431; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3432. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3465.

In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3466. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3465; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3466. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3499. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3500. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3499; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3500. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3533. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3534. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3533; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3534. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3567. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3568. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3567; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3568. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3601. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3602. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3601; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3602. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3635. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3636. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3635; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3636. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3669. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3670. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3669; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3670. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3703. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3704. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3703; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3704. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3737. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3738. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3737; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3738. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3771. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3772. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3771; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3772. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3805. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3806. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3805; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3806. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3839. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3840. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3839; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3840. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3873. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3874. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3873; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3874. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3907. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3908. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3907; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3908. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3941. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3942. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3941; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3942. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3975. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3976. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3975; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3976. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4009. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4010. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4009; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4010. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4043. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4044. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4043; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4044. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4077. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4078. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4077; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4078. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4111. In one embodiment, the first binding domain that binds TRDV2 comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4112. In one embodiment, the first binding domain that binds TRDV2 comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4111; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4112.

In another aspect, provided herein is a multispecific antibody that binds TRGDC. In some embodiments, the multispecific antibody is a bispecific antibody. In some embodiments, the multispecific antibody is a trispecific antibody. In some embodiments, the multispecific antibody is a quadraspecific antibody. In one embodiment, the multispecific TRGDC antibody comprises: (a) a first binding domain that binds TRGDC, and (b) a second binding domain that binds to a second target. In one embodiment, the multispecific TRGDC antibody comprises: (a) a first binding domain that binds TRGDC, and (b) a second binding domain that binds to a second target, and (c) a third binding domain that binds to a third target. In one embodiment, the multispecific TRGDC antibody comprises: (a) a first binding domain that binds TRGDC, and (b) a second binding domain that binds to a second target, (c) a third binding domain that binds to a third target, and (d) a fourth binding domain that binds to a fourth target.

In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4145. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4146. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4145; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4146. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4179. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4180. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4179; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4180. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4213. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4214. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4213; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4214. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4247. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4248. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4247; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4248. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4281. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4282. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4281; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4282. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4315. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4316. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4315; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4316. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4349. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4350. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4349; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4350. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4383. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4384. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4383; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4384. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4417. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4418. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4417; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4418. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4451. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4452. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4451; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4452. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4485. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4486. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4485; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4486. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4519. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4520. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4519; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4520. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4553. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4554. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4553; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4554. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4587. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4588. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4587; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4588. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4621. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4622. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4621; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4622. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4655. In one embodiment, the first binding domain that binds TRGDC comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4656. In one embodiment, the first binding domain that binds TRGDC comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4655; and a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4656.

In some embodiments, a multispecific antibody provided herein is a diabody, a cross-body, or a multispecific antibody obtained via a controlled Fab arm exchange as those described herein.

In some embodiments, the multispecific antibodies include IgG-like molecules with complementary CH3 domains that promote heterodimerization; recombinant IgG-like dual targeting molecules, wherein the two sides of the molecule each contain the Fab fragment or part of the Fab fragment of at least two different antibodies; IgG fusion molecules, wherein full length IgG antibodies are fused to an extra Fab fragment or parts of Fab fragment; Fc fusion molecules, wherein single chain Fv molecules or stabilized diabodies are fused to heavy-chain constant-domains, Fc-regions or parts thereof; Fab fusion molecules, wherein different Fab-fragments are fused together; ScFv- and diabody-based and heavy chain antibodies (e.g., domain antibodies, nanobodies) wherein different single chain Fv molecules or different diabodies or different heavy-chain antibodies (e.g. domain antibodies, nanobodies) are fused to each other or to another protein or carrier molecule.

In some embodiments, IgG-like molecules with complementary CH3 domains molecules include the Triomab/Quadroma (Trion Pharma/Fresenius Biotech), the Knobs-into-Holes (Genentech), CrossMAbs (Roche) and the electrostatically-matched (Amgen), the LUZ-Y (Genentech), the Strand Exchange Engineered Domain body (SEEDbody) (EMD Serono), the Biclonic (Merus) and the DuoBody (Genmab A/S).

In some embodiments, recombinant IgG-like dual targeting molecules include Dual Targeting (DT)-Ig (GSK/Domantis), Two-in-one Antibody (Genentech), Cross-linked Mabs (Karmanos Cancer Center), mAb2 (F-Star) and CovX-body (CovX/Pfizer).

In some embodiments, IgG fusion molecules include Dual Variable Domain (DVD)-Ig (Abbott), IgG-like Bispecific (ImClone/Eli Lilly), Ts2Ab (MedImmune/AZ) and BsAb (Zymogenetics), HERCULES (Biogen Idec) and TvAb (Roche).

In some embodiments, Fc fusion molecules can include ScFv/Fc Fusions (Academic Institution), SCORPION (Emergent BioSolutions/Trubion, Zymogenetics/BMS), Dual Affinity Retargeting Technology (Fc-DART) (MacroGenics) and Dual(ScFv)$_2$-Fab (National Research Center for Antibody Medicine—China).

In some embodiments, Fab fusion bispecific antibodies include F(ab)$_2$ (Medarex/AMGEN), Dual-Action or Bis-Fab (Genentech), Dock-and-Lock (DNL) (ImmunoMedics), Bivalent Bispecific (Biotecnol) and Fab-Fv (UCB-Celltech). ScFv-, diabody-based, and domain antibodies, include but are not limited to, Bispecific T Cell Engager (BiTE) (Micromet), Tandem Diabody (Tandab) (Affimed), Dual Affinity Retargeting Technology (DART) (MacroGenics), Single-chain Diabody (Academic), TCR-like Antibodies (AIT, ReceptorLogics), Human Serum Albumin ScFv Fusion (Merrimack) and COMBODY (Epigen Biotech), dual targeting nanobodies (Ablynx), dual targeting heavy chain only domain antibodies.

Full length bispecific antibodies provided herein can be generated for example using Fab arm exchange (or half molecule exchange) between two mono specific bivalent antibodies by introducing substitutions at the heavy chain CH3 interface in each half molecule to favor heterodimer formation of two antibody half molecules having distinct specificity either in vitro in cell-free environment or using co-expression. The Fab arm exchange reaction is the result of a disulfide-bond isomerization reaction and dissociation-association of CH3 domains. The heavy-chain disulfide bonds in the hinge regions of the parent mono specific antibodies are reduced. The resulting free cysteines of one of the parent monospecific antibodies form an inter heavy-chain disulfide bond with cysteine residues of a second parent mono specific antibody molecule and simultaneously CH3 domains of the parent antibodies release and reform by dissociation-association. The CH3 domains of the Fab arms can be engineered to favor heterodimerization over homodimerization. The resulting product is a bispecific antibody having two Fab arms or half molecules which each binding a distinct epitope, e.g., an epitope on CD8 and an epitope on CD4. Other methods of making multispecific antibodies are known and contemplated.

"Homodimerization" as used herein refers to an interaction of two heavy chains having identical CH3 amino acid sequences. "Homodimer" as used herein refers to an antibody having two heavy chains with identical CH3 amino acid sequences.

"Heterodimerization" as used herein refers to an interaction of two heavy chains having non-identical CH3 amino acid sequences. "Heterodimer" as used herein refers to an antibody having two heavy chains with non-identical CH3 amino acid sequences.

The "knob-in-hole" strategy (see, e.g., PCT Publ. No. WO2006/028936) can be used to generate full length bispecific antibodies. Briefly, selected amino acids forming the interface of the CH3 domains in human IgG can be mutated at positions affecting CH3 domain interactions to promote heterodimer formation. An amino acid with a small side chain (hole) is introduced into a heavy chain of an antibody specifically binding a first antigen and an amino acid with a large side chain (knob) is introduced into a heavy chain of an antibody specifically binding a second antigen. After co-expression of the two antibodies, a heterodimer is formed as a result of the preferential interaction of the heavy chain with a "hole" with the heavy chain with a "knob." Exemplary CH3 substitution pairs forming a knob and a hole are (expressed as modified position in the first CH3 domain of the first heavy chain/modified position in the second CH3 domain of the second heavy chain): T366Y/F405A, T366W/F405W, F405W/Y407A, T394W/Y407T, T394S/Y407A, T366W/T394S, F405W/T394S and T366W/T366S_L368A_Y407V.

Other strategies such as promoting heavy chain heterodimerization using electrostatic interactions by substituting positively charged residues at one CH3 surface and negatively charged residues at a second CH3 surface can be used, as described in US Pat. Publ. No. US2010/0015133; US Pat. Publ. No. US2009/0182127; US Pat. Publ. No. US2010/028637; or US Pat. Publ. No. US2011/0123532. In other strategies, heterodimerization can be promoted by the following substitutions (expressed as modified position in the first CH3 domain of the first heavy chain/modified position in the second CH3 domain of the second heavy chain): L351Y_F405AY407V/T394W, T366I_K392M_T394W/F405A_Y407V, T366L_K392M_T394W/F405A_Y407V, L351Y_Y407A/T366A_K409F, L351Y_Y407A/T366V_K409F_Y407A/T366A_K409F, or T350V_L351Y_F405A_Y407V/T350V_T366L_K392L T394W as described in U.S. Pat. Publ. No. US2012/0149876 or U.S. Pat. Publ. No. US2013/0195849.

In addition to methods described above, bispecific antibodies provided herein can be generated in vitro in a cell-free environment by introducing asymmetrical mutations in the CH3 regions of two mono specific homodimeric antibodies and forming the bispecific heterodimeric antibody from two parent monospecific homodimeric antibodies in reducing conditions to allow disulfide bond isomerization according to methods described in PCT Pat. Publ. No. WO2011/131746. In the methods, the first monospecific bivalent antibody and the second monospecific bivalent antibody are engineered to have certain substitutions at the CH3 domain that promotes heterodimer stability; the antibodies are incubated together under reducing conditions sufficient to allow the cysteines in the hinge region to undergo disulfide bond isomerization; thereby generating the bispecific antibody by Fab arm exchange. The incubation conditions can optionally be restored to non-reducing conditions. Exemplary reducing agents that can be used are 2-mercaptoethylamine (2-MEA), dithiothreitol (DTT), dithioerythritol (DTE), glutathione, tris (2-carboxyethyl) phosphine (TCEP), L-cysteine and beta-mercaptoethanol, preferably a reducing agent selected from the group consisting of: 2-mercaptoethylamine, dithiothreitol and tris (2-carboxyethyl) phosphine. For example, incubation for at least 90 min at a temperature of at least 20° C. in the presence of at least 25 mM 2-MEA or in the presence of at least 0.5 mM dithiothreitol at a pH from 5-8, for example at pH of 7.0 or at pH of 7.4 can be used.

In some embodiments, the TRGV9 antibody comprises a single chain antibody. In some embodiments, the TRGV9 antibody comprises a single domain antibody. In certain embodiments, the TRGV9 antibody comprises a nanobody. In certain embodiments, the TRGV9 antibody comprises a VHH antibody. In certain embodiments, the TRGV9 antibody comprises a llama antibody. In some embodiments, the TRGV9 antibody does not comprise a single chain antibody. In some embodiments, the TRGV9 antibody does not comprise a single domain antibody. In certain embodiments, the TRGV9 antibody does not comprise a nanobody. In certain embodiments, the TRGV9 antibody does not comprise a VHH antibody. In certain embodiments, the TRGV9 antibody does not comprise a llama antibody.

In some embodiments, the TRGV9 multispecific antibody comprises a single chain antibody. In some embodiments, the TRGV9 multispecific antibody comprises a single domain antibody. In certain embodiments, the TRGV9 multispecific antibody comprises a nanobody. In certain embodiments, the TRGV9 multispecific antibody comprises a VHH antibody. In certain embodiments, the TRGV9 multispecific antibody comprises a llama antibody. In some embodiments, the TRGV9 multispecific antibody does not comprise a single chain antibody. In some embodiments, the TRGV9 multispecific antibody does not comprise a single domain antibody. In certain embodiments, the TRGV9 multispecific antibody does not comprise a nanobody. In certain embodiments, the TRGV9 multispecific antibody does not comprise a VHH antibody. In certain embodiments, the TRGV9 multispecific antibody does not comprise a llama antibody.

According to another particular aspect, provided herein is a TRGV9 antibody or antigen-binding fragment thereof that induces antibody-dependent cell-mediated cytotoxicity (ADCC). The antibody or antigen-binding fragment thereof can, for example, induce ADCC in vitro.

In certain embodiments, the antibody or antigen-binding fragment thereof induces T cell dependent cytotoxicity of a second cell in vitro with an $EC_{50}$ of less than about 160 pM, when assessed in vitro at an effector to target cell ratio of 1:1.

In some embodiments, TRGV9 is present on the surface of a T cell. In some embodiments, the TRGV9 is present on the surface of a T cell, and the second target antigen is on the surface of a second cell. In some embodiments, the second cell is killed when the multispecific antibody binds to the TRGV9 on the surface of the T cell and the second target antigen on the surface of the second cell.

In some embodiments, the TRDV2 antibody comprises a single chain antibody. In some embodiments, the TRDV2 antibody comprises a single domain antibody. In certain embodiments, the TRDV2 antibody comprises a nanobody. In certain embodiments, the TRDV2 antibody comprises a VHH antibody. In certain embodiments, the TRDV2 antibody comprises a llama antibody. In some embodiments, the TRDV2 antibody does not comprise a single chain antibody. In some embodiments, the TRDV2 antibody does not comprise a single domain antibody. In certain embodiments, the TRDV2 antibody does not comprise a nanobody. In certain embodiments, the TRDV2 antibody does not comprise a VHH antibody. In certain embodiments, the TRDV2 antibody does not comprise a llama antibody.

In some embodiments, the TRDV2 multispecific antibody comprises a single chain antibody. In some embodiments, the TRDV2 multispecific antibody comprises a single domain antibody. In certain embodiments, the TRDV2 multispecific antibody comprises a nanobody. In certain embodiments, the TRDV2 multispecific antibody comprises a VHH antibody. In certain embodiments, the TRDV2 multispecific antibody comprises a llama antibody. In some embodiments, the TRDV2 multispecific antibody does not comprise a single chain antibody. In some embodiments, the TRDV2 multispecific antibody does not comprise a single domain antibody. In certain embodiments, the TRDV2 multispecific antibody does not comprise a nanobody. In certain embodiments, the TRDV2 multispecific antibody does not comprise a VHH antibody. In certain embodiments, the TRDV2 multispecific antibody does not comprise a llama antibody.

According to another particular aspect, provided herein is a TRDV2 antibody or antigen-binding fragment thereof that induces antibody-dependent cell-mediated cytotoxicity (ADCC). The antibody or antigen-binding fragment thereof can, for example, induce ADCC in vitro.

In certain embodiments, the antibody or antigen-binding fragment thereof induces T cell dependent cytotoxicity of a second cell in vitro with an $EC_{50}$ of less than about 160 pM, when assessed in vitro at an effector to target cell ratio of 1:1.

In some embodiments, TRDV2 is present on the surface of a T cell. In some embodiments, the TRDV2 is present on the surface of a T cell, and the second target antigen is on the surface of a second cell. In some embodiments, the second cell is killed when the multispecific antibody binds to the TRDV2 on the surface of the T cell and the second target antigen on the surface of the second cell.

In some embodiments, the TRGDC antibody comprises a single chain antibody. In some embodiments, the TRGDC antibody comprises a single domain antibody. In certain embodiments, the TRGDC antibody comprises a nanobody. In certain embodiments, the TRGDC antibody comprises a VHH antibody. In certain embodiments, the TRGDC antibody comprises a llama antibody. In some embodiments, the TRGDC antibody does not comprise a single chain antibody. In some embodiments, the TRGDC antibody does not comprise a single domain antibody. In certain embodiments, the TRGDC antibody does not comprise a nanobody. In certain embodiments, the TRGDC antibody does not comprise a VHH antibody. In certain embodiments, the TRGDC antibody does not comprise a llama antibody.

In some embodiments, the TRGDC multispecific antibody comprises a single chain antibody. In some embodiments, the TRGDC multispecific antibody comprises a single domain antibody. In certain embodiments, the TRGDC multispecific antibody comprises a nanobody. In certain embodiments, the TRGDC multispecific antibody comprises a VHH antibody. In certain embodiments, the TRGDC multispecific antibody comprises a llama antibody. In some embodiments, the TRGDC multispecific antibody does not comprise a single chain antibody. In some embodiments, the TRGDC multispecific antibody does not comprise a single domain antibody. In certain embodiments, the TRGDC multispecific antibody does not comprise a nanobody. In certain embodiments, the TRGDC multispecific antibody does not comprise a VHH antibody. In certain embodiments, the TRGDC multispecific antibody does not comprise a llama antibody.

According to another particular aspect, provided herein is a TRGDC antibody or antigen-binding fragment thereof that induces antibody-dependent cell-mediated cytotoxicity (ADCC). The antibody or antigen-binding fragment thereof can, for example, induce ADCC in vitro.

In certain embodiments, the antibody or antigen-binding fragment thereof induces T cell dependent cytotoxicity of a second cell in vitro with an $EC_{50}$ of less than about 160 pM, when assessed in vitro at an effector to target cell ratio of 1:1.

In some embodiments, TRGDC is present on the surface of a T cell. In some embodiments, the TRGDC is present on the surface of a T cell, and the second target antigen is on the surface of a second cell. In some embodiments, the second cell is killed when the multispecific antibody binds to the TRGDC on the surface of the T cell and the second target antigen on the surface of the second cell.

In some embodiments, the multispecific antibody induces T cell dependent cytotoxicity of the second cell in vitro with an $EC_{50}$ of less than about 500 pM. In some embodiments, the multispecific antibody induces T cell dependent cytotoxicity of the second cell in vitro with an $EC_{50}$ of less than about 300 pM. In some embodiments, the multispecific antibody induces γδ T cell dependent cytotoxicity of the second cell in vitro with an $EC_{50}$ of less than about 160 pM. In some embodiments, the $EC_{50}$ is assessed with a mixture of γδ T effector cells and target cells expressing the second target antigen. In some embodiments, the effector cell to target cell ratio is about 0.01 to 1 to about 5 to 1. In some embodiments, the effector cell to target cell ratio is about 0.1 to 1 to about 2 to 1. In some embodiments, the effector cell to target cell ratio is about 1:1.

In certain embodiments, the $EC_{50}$ is less than about 1000 pM, less than about 900 pM, less than about 800 pM, less than about 700 pM, less than about 600 pM, less than about 500 pM, less than about 400 pM, less than about 300 pM, less than about 200 pM, less than about 190 pM, less than about 180 pM, less than about 170 pM, less than about 160 pM, less than about 150 pM, less than about 140 pM, less than about 130 pM, less than about 120 pM, less than about 110 pM, less than about 100 pM, less than about 90 pM, less than about 80 pM, less than about 70 pM, less than about 60 pM, less than about 50 pM, less than about 40 pM, less than about 30 pM, less than about 20 pM, or less than about 10 pM.

In certain embodiments, the effector to target cell ratio can, for example, be 0.01:1, 0.02:1, 0.03:1, 0.04:1, 0.05:1, 0.06:1, 0.07:1, 0.08:1, 0.09:1, 1:1, 2:1, 3:1, 4:1, 5:1, 6:1, 7:1, 8:1, 9:1, or 10:1. In certain embodiments, the effector to target cell ratio can, for example, be between 0.01:1 and 10:1. In certain embodiments, the concentration of the multispecific antibody or antigen-binding fragment thereof is about 0.000005 ng/mL, about 0.00005 ng/mL, about 0.0005, about 0.005 ng/mL, about 0.01 ng/mL, about 0.02 ng/mL, about 0.03 ng/mL, about 0.04 ng/mL, about 0.05 ng/mL, about 0.06 ng/mL, about 0.07 ng/mL, about 0.08 ng/mL, about 0.09 ng/mL, about 0.1 ng/mL, about 0.5 ng/mL, about 1.0 ng/mL, about 10 ng/mL, about 20 ng/mL about, about 30 ng/mL about 40 ng/mL, about 50 ng/mL, about 60 ng/mL, about 70 ng/mL, about 80 ng/mL, about 90 ng/mL, about 100 ng/mL, or about 1000 ng/mL. In certain embodiments, the concentration of the multispecific antibody or antigen-binding fragment thereof is between about 0.000005 ng/mL and about 1000 ng/mL.

In another aspect, provided herein is an antibody that competes for binding to TRGV9 with any of the TRGV9 antibodies described herein. In another aspect, provided herein is an antibody that binds to the same epitope as any of the TRGV9 antibodies described herein. In another aspect, provided is a TRGV9 antibody that binds an epitope on TRGV9 that overlaps with the epitope on TRGV9 bound by a TRGV9 antibody described herein. In some embodiments, the TRGV9 antibody comprises a VH CDR1, VH CDR2, and VH CDR3 of a TRGV9 antibody provided herein. In some embodiments, the TRGV9 antibody comprises a VL CDR1, VL CDR2, and VL CDR3 of a TRGV9 antibody provided herein. In some embodiments, the TRGV9 antibody comprises a VH CDR1, VH CDR2, VH CDR3, a VL CDR1, VL CDR2, and VL CDR3 of a TRGV9 antibody provided herein. In some embodiments, the TRGV9 antibody comprises a VH of a TRGV9 antibody provided herein. In some embodiments, the TRGV9 antibody comprises a VL of a TRGV9 antibody provided herein. In some embodiments, the TRGV9 antibody comprises a VH and a VL of a TRGV9 antibody provided herein. In some embodiments, the TRGV9 antibody comprises a VH CDR1, VH CDR2, VH CDR3, a VL CDR1, VL CDR2, and VL CDR3 of a TRGV9 antibody provided herein. In some embodiments, the VH CDR1, VH CDR2, VH CDR3, VL CDR1, VL CDR2, and VL CDR3 amino acid sequences of the TRGV9 antibody are according to the Kabat numbering system. In some embodiments, the VH CDR1, VH CDR2, VH CDR3, VL CDR1, VL CDR2, and VL CDR3 amino acid sequences of the TRGV9 antibody are according to the Chothia numbering system. In some embodiments, the VH CDR1, VH CDR2, VH CDR3, VL CDR1, VL CDR2, and VL CDR3 amino acid sequences of the TRGV9 antibody are according to the AbM numbering system. In some embodiments, the VH CDR1, VH CDR2, VH CDR3, VL CDR1, VL CDR2, and VL CDR3 amino acid sequences of the TRGV9 antibody are according to the Contact numbering system. In some embodiments, the VH CDR1, VH CDR2, VH CDR3, VL CDR1, VL CDR2, and VL CDR3 amino acid sequences of the TRGV9 antibody are according to the IMGT numbering system. In certain embodiments, the TRGV9 antibody is a multispecific antibody. In some embodiments, the TRGV9 antibody is a bispecific antibody.

In another aspect, provided is an antibody that competes for binding to TRGV9 with a TRGV9 reference antibody. In another aspect, provided is a TRGV9 antibody that binds to the same TRGV9 epitope as a TRGV9 reference antibody. In another aspect, provided is a TRGV9 antibody that binds an epitope on TRGV9 that overlaps with the epitope on TRGV9 bound by a TRGV9 reference antibody. In some embodiments, the TRGV9 reference antibody comprises a VH CDR1, VH CDR2, and VH CDR3 of a TRGV9 reference antibody provided herein. In some embodiments, the TRGV9 reference antibody comprises a VL CDR1, VL CDR2, and VL CDR3 of a TRGV9 reference antibody provided herein. In some embodiments, the TRGV9 reference antibody comprises a VH CDR1, VH CDR2, VH CDR3, a VL CDR1, VL CDR2, and VL CDR3 of a TRGV9 reference antibody provided herein. In some embodiments, the TRGV9 reference antibody comprises a VH of a TRGV9 reference antibody provided herein. In some embodiments, the TRGV9 reference antibody comprises a VL of a TRGV9 reference antibody provided herein. In some embodiments, the TRGV9 reference antibody comprises a VH and a VL of a TRGV9 reference antibody provided herein. In some embodiments, the TRGV9 reference antibody comprises a VH CDR1, VH CDR2, VH CDR3, a VL CDR1, VL CDR2, and VL CDR3 of a TRGV9 reference antibody provided herein. In some embodiments, the VH CDR1, VH CDR2, VH CDR3, VL CDR1, VL CDR2, and VL CDR3 amino acid sequences of the TRGV9 reference antibody are according to the Kabat numbering system. In some embodiments, the VH CDR1, VH CDR2, VH CDR3, VL CDR1, VL CDR2, and VL CDR3 amino acid sequences of the TRGV9 reference antibody are according to the Chothia numbering system. In some embodiments, the VH CDR1, VH CDR2, VH CDR3, VL CDR1, VL CDR2, and VL CDR3 amino acid sequences of the TRGV9 reference antibody are according to the AbM numbering system. In some embodiments, the VH CDR1, VH CDR2, VH CDR3, VL CDR1, VL CDR2, and VL CDR3 amino acid sequences of the TRGV9 reference antibody are according to the Contact numbering system. In some embodiments, the VH CDR1, VH CDR2, VH CDR3, VL CDR1, VL CDR2, and VL CDR3 amino acid sequences of the TRGV9 reference antibody are according to the IMGT numbering system. In certain embodiments, the antibody is a multispecific antibody. In some embodiments, the antibody is a bispecific antibody. In certain embodiments, the TRGV9 reference antibody is a multispecific antibody. In some embodiments, the TRGV9 reference antibody is a bispecific antibody.

In another aspect, provided herein is an antibody that competes for binding to TRDV2 with any of the TRDV2 antibodies described herein. In another aspect, provided herein is an antibody that binds to the same epitope as any of the TRDV2 antibodies described herein. In another aspect, provided is a TRDV2 antibody that binds an epitope on TRDV2 that overlaps with the epitope on TRDV2 bound by a TRDV2 antibody described herein. In some embodiments, the TRDV2 antibody comprises a VH CDR1, VH CDR2, and VH CDR3 of a TRDV2 antibody provided herein. In some embodiments, the TRDV2 antibody comprises a VL CDR1, VL CDR2, and VL CDR3 of a TRDV2 antibody provided herein. In some embodiments, the TRDV2 antibody comprises a VH CDR1, VH CDR2, VH CDR3, a VL CDR1, VL CDR2, and VL CDR3 of a TRDV2 antibody provided herein. In some embodiments, the TRDV2 antibody comprises a VH of a TRDV2 antibody provided herein. In some embodiments, the TRDV2 antibody comprises a VL of a TRDV2 antibody provided herein.

In some embodiments, the TRDV2 antibody comprises a VH and a VL of a TRDV2 antibody provided herein. In some embodiments, the TRDV2 antibody comprises a VH CDR1, VH CDR2, VH CDR3, a VL CDR1, VL CDR2, and VL CDR3 of a TRDV2 antibody provided herein. In some embodiments, the VH CDR1, VH CDR2, VH CDR3, VL CDR1, VL CDR2, and VL CDR3 amino acid sequences of the TRDV2 antibody are according to the Kabat numbering system. In some embodiments, the VH CDR1, VH CDR2, VH CDR3, VL CDR1, VL CDR2, and VL CDR3 amino acid sequences of the TRDV2 antibody are according to the Chothia numbering system. In some embodiments, the VH CDR1, VH CDR2, VH CDR3, VL CDR1, VL CDR2, and VL CDR3 amino acid sequences of the TRDV2 antibody are according to the AbM numbering system. In some embodiments, the VH CDR1, VH CDR2, VH CDR3, VL CDR1, VL CDR2, and VL CDR3 amino acid sequences of the TRDV2 antibody are according to the Contact numbering system. In some embodiments, the VH CDR1, VH CDR2, VH CDR3, VL CDR1, VL CDR2, and VL CDR3 amino acid sequences of the TRDV2 antibody are according to the IMGT numbering system. In certain embodiments, the TRDV2 antibody is a multispecific antibody. In some embodiments, the TRDV2 antibody is a bispecific antibody.

In another aspect, provided is an antibody that competes for binding to TRDV2 with a TRDV2 reference antibody. In another aspect, provided is a TRDV2 antibody that binds to the same TRDV2 epitope as a TRDV2 reference antibody. In another aspect, provided is a TRDV2 antibody that binds an epitope on TRDV2 that overlaps with the epitope on TRDV2 bound by a TRDV2 reference antibody. In some embodiments, the TRDV2 reference antibody comprises a VH CDR1, VH CDR2, and VH CDR3 of a TRDV2 reference antibody provided herein. In some embodiments, the TRDV2 reference antibody comprises a VL CDR1, VL CDR2, and VL CDR3 of a TRDV2 reference antibody provided herein. In some embodiments, the TRDV2 reference antibody comprises a VH CDR1, VH CDR2, VH CDR3, a VL CDR1, VL CDR2, and VL CDR3 of a TRDV2 reference antibody provided herein. In some embodiments, the TRDV2 reference antibody comprises a VH of a TRDV2 reference antibody provided herein. In some embodiments, the TRDV2 reference antibody comprises a VL of a TRDV2 reference antibody provided herein. In some embodiments, the TRDV2 reference antibody comprises a VH and a VL of a TRDV2 reference antibody provided herein. In some embodiments, the TRDV2 reference antibody comprises a VH CDR1, VH CDR2, VH CDR3, a VL CDR1, VL CDR2, and VL CDR3 of a TRDV2 reference antibody provided herein. In some embodiments, the VH CDR1, VH CDR2, VH CDR3, VL CDR1, VL CDR2, and VL CDR3 amino acid sequences of the TRDV2 reference antibody are according to the Kabat numbering system. In some embodiments, the VH CDR1, VH CDR2, VH CDR3, VL CDR1, VL CDR2, and VL CDR3 amino acid sequences of the TRDV2 reference antibody are according to the Chothia numbering system. In some embodiments, the VH CDR1, VH CDR2, VH CDR3, VL CDR1, VL CDR2, and VL CDR3 amino acid sequences of the TRDV2 reference antibody are according to the AbM numbering system. In some embodiments, the VH CDR1, VH CDR2, VH CDR3, VL CDR1, VL CDR2, and VL CDR3 amino acid sequences of the TRDV2 reference antibody are according to the Contact numbering system. In some embodiments, the VH CDR1, VH CDR2, VH CDR3, VL CDR1, VL CDR2, and VL CDR3 amino acid sequences of the TRDV2 reference antibody are according to the IMGT numbering system. In certain embodiments, the antibody is a multispecific antibody. In some embodiments, the antibody is a bispecific antibody. In certain embodiments, the TRDV2 reference antibody is a multispecific antibody. In some embodiments, the TRDV2 reference antibody is a bispecific antibody.

In another aspect, provided herein is an antibody that competes for binding to TRGDC with any of the TRGDC antibodies described herein. In another aspect, provided herein is an antibody that binds to the same epitope as any of the TRGDC antibodies described herein. In another aspect, provided is a TRGDC antibody that binds an epitope on TRGDC that overlaps with the epitope on TRGDC bound by a TRGDC antibody described herein. In some embodiments, the TRGDC antibody comprises a VH CDR1, VH CDR2, and VH CDR3 of a TRGDC antibody provided herein. In some embodiments, the TRGDC antibody comprises a VL CDR1, VL CDR2, and VL CDR3 of a TRGDC antibody provided herein. In some embodiments, the TRGDC antibody comprises a VH CDR1, VH CDR2, VH CDR3, a VL CDR1, VL CDR2, and VL CDR3 of a TRGDC antibody provided herein. In some embodiments, the TRGDC antibody comprises a VH of a TRGDC antibody provided herein. In some embodiments, the TRGDC antibody comprises a VL of a TRGDC antibody provided herein. In some embodiments, the TRGDC antibody comprises a VH and a VL of a TRGDC antibody provided herein. In some embodiments, the TRGDC antibody comprises a VH CDR1, VH CDR2, VH CDR3, a VL CDR1, VL CDR2, and VL CDR3 of a TRGDC antibody provided herein. In some embodiments, the VH CDR1, VH CDR2, VH CDR3, VL CDR1, VL CDR2, and VL CDR3 amino acid sequences of the TRGDC antibody are according to the Kabat numbering system. In some embodiments, the VH CDR1, VH CDR2, VH CDR3, VL CDR1, VL CDR2, and VL CDR3 amino acid sequences of the TRGDC antibody are according to the Chothia numbering system. In some embodiments, the VH CDR1, VH CDR2, VH CDR3, VL CDR1, VL CDR2, and VL CDR3 amino acid sequences of the TRGDC antibody are according to the AbM numbering system. In some embodiments, the VH CDR1, VH CDR2, VH CDR3, VL CDR1, VL CDR2, and VL CDR3 amino acid sequences of the TRGDC antibody are according to the Contact numbering system. In some embodiments, the VH CDR1, VH CDR2, VH CDR3, VL CDR1, VL CDR2, and VL CDR3 amino acid sequences of the TRGDC antibody are according to the IMGT numbering system. In certain embodiments, the TRGDC antibody is a multispecific antibody. In some embodiments, the TRGDC antibody is a bispecific antibody.

In another aspect, provided is an antibody that competes for binding to TRGDC with a TRGDC reference antibody. In another aspect, provided is a TRGDC antibody that binds to the same TRGDC epitope as a TRGDC reference antibody. In another aspect, provided is a TRGDC antibody that binds an epitope on TRGDC that overlaps with the epitope on TRGDC bound by a TRGDC reference antibody. In some embodiments, the TRGDC reference antibody comprises a VH CDR1, VH CDR2, and VH CDR3 of a TRGDC reference antibody provided herein. In some embodiments, the TRGDC reference antibody comprises a VL CDR1, VL CDR2, and VL CDR3 of a TRGDC reference antibody provided herein. In some embodiments, the TRGDC reference antibody comprises a VH CDR1, VH CDR2, VH CDR3, a VL CDR1, VL CDR2, and VL CDR3 of a TRGDC reference antibody provided herein. In some embodiments, the TRGDC reference antibody comprises a VH of a TRGDC reference antibody provided herein. In some embodiments, the TRGDC reference antibody comprises a VL of a TRGDC reference antibody provided herein. In some embodiments, the TRGDC reference antibody comprises a VH and a VL of a TRGDC reference antibody provided herein. In some embodiments, the TRGDC reference antibody comprises a VH CDR1, VH CDR2, VH CDR3, a VL CDR1, VL CDR2, and VL CDR3 of a TRGDC reference antibody provided herein. In some embodiments, the VH CDR1, VH CDR2, VH CDR3, VL CDR1, VL CDR2, and VL CDR3 amino acid sequences of the TRGDC reference antibody are according to the Kabat numbering system. In some embodiments, the VH CDR1, VH CDR2, VH CDR3, VL CDR1, VL CDR2, and VL CDR3 amino acid sequences of the TRGDC reference antibody are according to the Chothia numbering system. In some embodiments, the VH CDR1, VH CDR2, VH CDR3, VL CDR1, VL CDR2, and VL CDR3 amino acid sequences of the TRGDC reference antibody are according to the AbM numbering system. In some embodiments, the VH CDR1, VH CDR2, VH CDR3, VL CDR1, VL CDR2, and VL CDR3 amino acid sequences of the TRGDC reference antibody are according to the Contact numbering system. In some embodiments, the VH CDR1, VH CDR2, VH CDR3, VL CDR1, VL CDR2, and VL CDR3 amino acid sequences of the TRGDC reference antibody are according to the IMGT numbering system. In certain embodiments, the antibody is a multispecific antibody. In some embodiments, the antibody is a bispecific antibody. In certain embodiments, the TRGDC reference antibody is a multispecific antibody. In some embodiments, the TRGDC reference antibody is a bispecific antibody.

In some embodiments described herein, immune effector properties of the antibodies provided herein can be enhanced or silenced through Fc modifications by techniques known to those skilled in the art. For example, Fc effector functions such as C1q binding, complement dependent cytotoxicity (CDC), antibody-dependent cell-mediated cytotoxicity (ADCC), antibody-dependent cell-mediated phagocytosis (ADCP), down regulation of cell surface receptors (e.g., B cell receptor; BCR), etc. can be provided and/or controlled by modifying residues in the Fc responsible for these activities.

"Antibody-dependent cell-mediated cytotoxicity" or "ADCC" refers to a cell-mediated reaction in which non-specific cytotoxic cells that express Fc receptors (FcRs) (e.g. Natural Killer (NK) cells, neutrophils, and macrophages) recognize bound antibody on a target cell and subsequently cause lysis of the target cell.

The ability of antibodies to induce ADCC can be enhanced by engineering their oligosaccharide component. Human IgG1 or IgG3 are N-glycosylated at Asn297 with the majority of the glycans in the well-known biantennary G0, G0F, G1, G1F, G2 or G2F forms. Antibodies produced by non-engineered CHO cells typically have a glycan fucose content of about at least 85%. The removal of the core fucose from the biantennary complex-type oligosaccharides attached to the Fc regions enhances the ADCC of antibodies via improved FcγRIIIa binding without altering antigen binding or CDC activity. Such Abs can be achieved using different methods reported to lead to the successful expression of relatively high defucosylated antibodies bearing the biantennary complex-type of Fc oligosaccharides such as control of culture osmolality (Konno et al., Cytotechnology 64:249-65, 2012), application of a variant CHO line Lec13 as the host cell line (Shields et al., J Biol Chem 277:26733-26740, 2002), application of a variant CHO line EB66 as the host cell line (Olivier et al., MAbs; 2(4), 2010; Epub ahead of print; PMID:20562582), application of a rat hybridoma cell line YB2/0 as the host cell line (Shinkawa et al., J Biol Chem 278:3466-3473, 2003), introduction of small interfering RNA specifically against the α-1,6-fucosyltrasferase (FUT8) gene (Mori et al., Biotechnol Bioeng 88:901-908, 2004), or coexpression of β-1,4-N-acetylglucosaminyltransferase III and golgi α-mannosidase II or a potent alpha-mannosidase I inhibitor, kifunensine (Ferrara et al., J Biol Chem 281:5032-5036, 2006, Ferrara et al., Biotechnol Bioeng 93:851-861, 2006; Xhou et al., Biotechnol Bioeng 99:652-65, 2008).

In some embodiments described herein, ADCC elicited by the antibodies provided herein can also be enhanced by certain substitutions in the antibody Fc. Exemplary substitutions are for example substitutions at amino acid positions 256, 290, 298, 312, 356, 330, 333, 334, 360, 378 or 430 (residue numbering according to the EU index) as described in U.S. Pat. No. 6,737,056.

In some embodiments, a TRGV9 antibody provided herein is chimeric. In some embodiments, a TRGV9 antibody provided herein is human. In some embodiments, a TRGV9 antibody provided herein is humanized. In certain embodiments, a TRGV9 antibody provided herein is an isolated TRGV9 antibody. In some embodiments, a TRGV9 antigen binding fragment provided herein is chimeric. In some embodiments, a TRGV9 antigen binding fragment provided herein is human. In some embodiments, a TRGV9 antigen binding fragment provided herein is humanized. In certain embodiments, a TRGV9 antigen binding fragment provided herein is an isolated TRGV9 antigen binding fragment. In some embodiments, a TRGV9 antibody provided herein is an IgG antibody. In some embodiments, the IgG antibody is an IgG1 antibody. In some embodiments, the IgG antibody is an IgG2 antibody. In some embodiments, the IgG antibody is an IgG3 antibody. In some embodiments, the IgG antibody is an IgG4 antibody. In some embodiments, a TRGV9 antibody provided herein is multivalent. In some embodiments, the antibody is capable of binding at least three antigens. In some embodiments, a TRGV9 antibody provided herein is multivalent. In some embodiments, the antibody is capable of binding at least four antigens. In some embodiments, the antibody is capable of binding at least five antigens.

In some embodiments, a TRGV9 multispecific antibody provided herein is chimeric. In some embodiments, a TRGV9 multispecific antibody provided herein is human. In some embodiments, a TRGV9 multispecific antibody provided herein is humanized. In certain embodiments, a TRGV9 multispecific antibody provided herein is an isolated TRGV9 multispecific antibody. In some embodiments, a TRGV9 multispecific antibody comprising a TRGV9 antigen binding fragment provided herein is chimeric. In some embodiments, a TRGV9 multispecific antibody comprising a TRGV9 antigen binding fragment provided herein is human. In some embodiments, a TRGV9 multispecific antibody comprising a TRGV9 antigen binding fragment provided herein is humanized. In certain embodiments, a TRGV9 multispecific antibody comprising a TRGV9 antigen binding fragment provided herein is an isolated TRGV9 multispecific antibody.

In some embodiments of the TRGV9 multispecific antibodies provided herein, the first binding domain is human. In some embodiments, the second binding domain is human. In some embodiments of the TRGV9 multispecific antibodies provided herein, both the first binding domain and the second binding domain are human. In some embodiments of the TRGV9 multispecific antibodies provided herein, the first binding domain is humanized. In some embodiments of the TRGV9 multispecific antibodies provided herein, the second binding domain is humanized. In some embodiments of the TRGV9 multispecific antibodies provided herein, both the first binding domain and the second binding domain are humanized. In some embodiments of the TRGV9 multispecific antibodies provided herein, both the first binding domain is human and the second binding domain is humanized. In some embodiments of the TRGV9 multispecific antibodies provided herein, both the first binding domain is humanized and the second binding domain is human.

In some embodiments, a TRGV9 multispecific antibody provided herein is multivalent. In some embodiments, the multispecific antibody is capable of binding at least three antigens. In some embodiments, the multispecific antibody is capable of binding at least five antigens. In certain embodiments, the multispecific antibody is a multispecific antibody. In some embodiments, a TRGV9 multispecific antibody provided herein is an IgG antibody. In some embodiments, the IgG antibody is an IgG1 antibody. In some embodiments, the IgG antibody is an IgG2 antibody. In some embodiments, the IgG antibody is an IgG3 antibody. In some embodiments, the IgG antibody is an IgG4 antibody.

In certain embodiments, the antibodies provided herein are part of a multispecific antibody. In some embodiments, the multispecific antibody comprises a first binding domain that binds to a TRGV9 antigen. In some embodiments, the multispecific antibody comprises a first binding domain that binds to a TRGV9 antigen and comprises a second binding domain that binds to a second target antigen, as provided herein. In certain embodiments, the multispecific antibody binds to a TRGV9 antigen, a second target antigen, and one or more additional antigens. In some embodiments of the various antibodies provided herein, the antibody binds to an epitope of a given antigen.

In some embodiments, a TRDV2 antibody provided herein is chimeric. In some embodiments, a TRDV2 antibody provided herein is human. In some embodiments, a TRDV2 antibody provided herein is humanized. In certain embodiments, a TRDV2 antibody provided herein is an isolated TRDV2 antibody. In some embodiments, a TRDV2 antigen binding fragment provided herein is chimeric. In some embodiments, a TRDV2 antigen binding fragment provided herein is human. In some embodiments, a TRDV2 antigen binding fragment provided herein is humanized. In certain embodiments, a TRDV2 antigen binding fragment provided herein is an isolated TRDV2 antigen binding fragment. In some embodiments, a TRDV2 antibody provided herein is an IgG antibody. In some embodiments, the IgG antibody is an IgG1 antibody. In some embodiments, the IgG antibody is an IgG2 antibody. In some embodiments, the IgG antibody is an IgG3 antibody. In some embodiments, the IgG antibody is an IgG4 antibody. In some embodiments, a TRDV2 antibody provided herein is multivalent. In some embodiments, the antibody is capable of binding at least three antigens. In some embodiments, the antibody is capable of binding at least four antigens. In some embodiments, the antibody is capable of binding at least five antigens.

In some embodiments, a TRDV2 multispecific antibody provided herein is chimeric. In some embodiments, a TRDV2 multispecific antibody provided herein is human. In some embodiments, a TRDV2 multispecific antibody provided herein is humanized. In certain embodiments, a TRDV2 multispecific antibody provided herein is an isolated TRDV2 multispecific antibody. In some embodiments, a TRDV2 multispecific antibody comprising a TRDV2 antigen binding fragment provided herein is chimeric. In some embodiments, a TRDV2 multispecific antibody comprising a TRDV2 antigen binding fragment provided herein is human. In some embodiments, a TRDV2 multispecific antibody comprising a TRDV2 antigen binding fragment provided herein is humanized. In certain embodiments, a TRDV2 multispecific antibody comprising a TRDV2 antigen binding fragment provided herein is an isolated TRDV2 multispecific antibody.

In some embodiments of the TRDV2 multispecific antibodies provided herein, the first binding domain is human. In some embodiments, the second binding domain is human. In some embodiments of the TRDV2 multispecific antibodies provided herein, both the first binding domain and the second binding domain are human. In some embodiments of the TRDV2 multispecific antibodies provided herein, the first binding domain is humanized. In some embodiments of the TRDV2 multispecific antibodies provided herein, the second binding domain is humanized. In some embodiments of the TRDV2 multispecific antibodies provided herein, both the first binding domain and the second binding domain are humanized. In some embodiments of the TRDV2 multispecific antibodies provided herein, both the first binding domain is human and the second binding domain is humanized. In some embodiments of the TRDV2 multispecific antibodies provided herein, both the first binding domain is humanized and the second binding domain is human.

In some embodiments, a TRDV2 multispecific antibody provided herein is multivalent. In some embodiments, the multispecific antibody is capable of binding at least three antigens. In some embodiments, the multispecific antibody is capable of binding at least five antigens. In certain embodiments, the multispecific antibody is a multispecific antibody. In some embodiments, a TRDV2 multispecific antibody provided herein is an IgG antibody. In some embodiments, the IgG antibody is an IgG1 antibody. In some embodiments, the IgG antibody is an IgG2 antibody. In some embodiments, the IgG antibody is an IgG3 antibody. In some embodiments, the IgG antibody is an IgG4 antibody.

In certain embodiments, the antibodies provided herein are part of a multispecific antibody. In some embodiments, the multispecific antibody comprises a first binding domain that binds to a TRDV2 antigen. In some embodiments, the multispecific antibody comprises a first binding domain that binds to a TRDV2 antigen and comprises a second binding domain that binds to a second target antigen, as provided herein. In certain embodiments, the multispecific antibody binds to a TRDV2 antigen, a second target antigen, and one or more additional antigens. In some embodiments of the various antibodies provided herein, the antibody binds to an epitope of a given antigen.

In some embodiments, a TRGDC antibody provided herein is chimeric. In some embodiments, a TRGDC antibody provided herein is human. In some embodiments, a TRGDC antibody provided herein is humanized. In certain embodiments, a TRGDC antibody provided herein is an isolated TRGDC antibody. In some embodiments, a TRGDC antigen binding fragment provided herein is chimeric. In some embodiments, a TRGDC antigen binding fragment provided herein is human. In some embodiments, a TRGDC antigen binding fragment provided herein is humanized. In certain embodiments, a TRGDC antigen binding fragment provided herein is an isolated TRGDC antigen binding fragment. In some embodiments, a TRGDC antibody provided herein is an IgG antibody. In some embodiments, the IgG antibody is an IgG1 antibody. In some embodiments, the IgG antibody is an IgG2 antibody. In some embodiments, the IgG antibody is an IgG3 antibody. In some embodiments, the IgG antibody is an IgG4 antibody. In some embodiments, a TRGDC antibody provided herein is multivalent. In some embodiments, the antibody is capable of binding at least three antigens. In some embodiments, the antibody is capable of binding at least four antigens. In some embodiments, the antibody is capable of binding at least five antigens.

In some embodiments, a TRGDC multispecific antibody provided herein is chimeric. In some embodiments, a TRGDC multispecific antibody provided herein is human. In some embodiments, a TRGDC multispecific antibody provided herein is humanized. In certain embodiments, a TRGDC multispecific antibody provided herein is an isolated TRGDC multispecific antibody. In some embodiments, a TRGDC multispecific antibody comprising a TRGDC antigen binding fragment provided herein is chimeric. In some embodiments, a TRGDC multispecific antibody comprising a TRGDC antigen binding fragment provided herein is human. In some embodiments, a TRGDC multispecific antibody comprising a TRGDC antigen binding fragment provided herein is humanized. In certain embodiments, a TRGDC multispecific antibody comprising a TRGDC antigen binding fragment provided herein is an isolated TRGDC multispecific antibody.

In some embodiments of the TRGDC multispecific antibodies provided herein, the first binding domain is human. In some embodiments, the second binding domain is human. In some embodiments of the TRGDC multispecific antibodies provided herein, both the first binding domain and the second binding domain are human. In some embodiments of the TRGDC multispecific antibodies provided herein, the first binding domain is humanized. In some embodiments of the TRGDC multispecific antibodies provided herein, the second binding domain is humanized. In some embodiments of the TRGDC multispecific antibodies provided herein, both the first binding domain and the second binding domain are humanized. In some embodiments of the TRGDC multispecific antibodies provided herein, both the first binding domain is human and the second binding domain is humanized. In some embodiments of the TRGDC multispecific antibodies provided herein, both the first binding domain is humanized and the second binding domain is human.

In some embodiments, a TRGDC multispecific antibody provided herein is multivalent. In some embodiments, the multispecific antibody is capable of binding at least three antigens. In some embodiments, the multispecific antibody is capable of binding at least five antigens. In certain embodiments, the multispecific antibody is a multispecific antibody. In some embodiments, a TRGDC multispecific antibody provided herein is an IgG antibody. In some embodiments, the IgG antibody is an IgG1 antibody. In some embodiments, the IgG antibody is an IgG2 antibody. In some embodiments, the IgG antibody is an IgG3 antibody. In some embodiments, the IgG antibody is an IgG4 antibody.

In certain embodiments, the antibodies provided herein are part of a multispecific antibody. In some embodiments, the multispecific antibody comprises a first binding domain that binds to a TRGDC antigen. In some embodiments, the multispecific antibody comprises a first binding domain that binds to a TRGDC antigen and comprises a second binding domain that binds to a second target antigen, as provided herein. In certain embodiments, the multispecific antibody binds to a TRGDC antigen, a second target antigen, and one or more additional antigens. In some embodiments of the various antibodies provided herein, the antibody binds to an epitope of a given antigen.

Also provided is a nucleic acid sequence encoding an antibody provided herein. In another general aspect, provide is a vector comprising an isolated nucleic acid sequence encoding an antibody provided herein. In another general aspect, provided is a vector comprising an isolated nucleic acid sequence encoding an antibody provided herein. Also provided is a vector comprising a nucleic acid sequence encoding an antibody provided herein. Also provided is a host cell comprising a vector comprising a nucleic acid sequence encoding an antibody provided herein. Also provided is a kit comprising the vector comprising a nucleic acid sequence encoding an antibody provided herein, and packaging for the same. In another general aspect, provided herein is an isolated nucleic acid sequence encoding a monoclonal antibody or antigen-binding fragment thereof provided herein. In certain embodiments, the antibody is a TRGV9 antibody. In certain embodiments, the antibody is a TRDV2 antibody. In certain embodiments, the antibody is a TRGDC antibody.

It will be appreciated by those skilled in the art that the coding sequence of a protein can be changed (e.g., replaced, deleted, inserted, etc.) without changing the amino acid sequence of the protein. Accordingly, it will be understood by those skilled in the art that nucleic acid sequences encoding antibodies provided herein can be altered without changing the amino acid sequences of the proteins.

Any vector known to those skilled in the art in view of the present disclosure can be used, such as a plasmid, a cosmid, a phage vector or a viral vector. In some embodiments, the vector is a recombinant expression vector such as a plasmid. The vector can include any element to establish a conventional function of an expression vector, for example, a promoter, ribosome binding element, terminator, enhancer, selection marker, and origin of replication. The promoter can be a constitutive, inducible or repressible promoter. A number of expression vectors capable of delivering nucleic acids to a cell are known in the art and can be used herein for production of an antibody or antigen-binding fragment thereof in the cell. Conventional cloning techniques or artificial gene synthesis can be used to generate a recombinant expression vector according to certain embodiments. Such techniques are well known to those skilled in the art in view of the present disclosure.

Also provided is a host cell comprising an isolated nucleic acid sequence encoding an antibody provided herein. Also provided is a host cell comprising an isolated nucleic acid sequence encoding an antigen binding fragment provided herein. Any host cell known to those skilled in the art in view of the present disclosure can be used for recombinant expression of antibodies or antigen-binding fragments thereof provided herein. In some embodiments, the host cells are *E. coli* TG1 or BL21 cells (for expression of, e.g., an scFv or Fab antibody), CHO-DG44 or CHO-K1 cells or HEK293 cells (for expression of, e.g., a full-length IgG antibody). According to particular embodiments, the recombinant expression vector is transformed into host cells by conventional methods such as chemical transfection, heat shock, or electroporation, where it is stably integrated into the host cell genome such that the recombinant nucleic acid sequence is effectively expressed.

Also provided are methods of producing an antibody disclosed herein. The methods comprise culturing a cell comprising a nucleic acid encoding the antibody under conditions to produce an antibody and recovering the antibody from the cell or cell culture (e.g., from the supernatant). Expressed antibodies can be harvested from the cells and purified according to conventional techniques known in the art and as described herein.

Pharmaceutical Compositions

In another general aspect, provided is a pharmaceutical composition comprising a TRGV9 antibody provided herein and a pharmaceutically acceptable carrier. In another general aspect, provided is a pharmaceutical composition comprising a TRDV2 antibody provided herein and a pharmaceutically acceptable carrier. In another general aspect, provided is a pharmaceutical composition comprising a TRGDC antibody provided herein and a pharmaceutically acceptable carrier. In certain embodiments, the antibody is isolated. Also provided is a method of producing the pharmaceutical composition, comprising combining the antibody with a pharmaceutically acceptable carrier to obtain the pharmaceutical composition.

In another aspect, provided herein is a pharmaceutical composition comprising a comprising: (a) a first binding domain that binds to TRGV9, and (b) a second binding domain that binds to a second target, and a pharmaceutically acceptable carrier. In another aspect, provided herein is a pharmaceutical composition comprising a comprising: (a) a first binding domain that binds to TRDV2, and (b) a second binding domain that binds to a second target, and a pharmaceutically acceptable carrier. In another aspect, provided herein is a pharmaceutical composition comprising a comprising: (a) a first binding domain that binds to TRGDC, and (b) a second binding domain that binds to a second target, and a pharmaceutically acceptable carrier. Any of the multispecific antibodies provided herein are contemplated in the pharmaceutical compositions.

The term "pharmaceutical composition" as used herein means a product comprising an antibody provided herein together with a pharmaceutically acceptable carrier. Antibodies of provided herein and compositions comprising them are also useful in the manufacture of a medicament for therapeutic applications.

As used herein, the term "carrier" refers to any excipient, diluent, filler, salt, buffer, stabilizer, solubilizer, oil, lipid, lipid containing vesicle, microsphere, liposomal encapsulation, or other material well known in the art for use in pharmaceutical formulations. It will be understood that the characteristics of the carrier, excipient or diluent will depend on the route of administration for a particular application. As used herein, the term "pharmaceutically acceptable carrier" refers to a non-toxic material that does not interfere with the effectiveness of a composition provided herein the biological activity of a composition provided herein. According to particular embodiments, in view of the present disclosure, any pharmaceutically acceptable carrier suitable for use in an antibody pharmaceutical composition can be used herein.

The formulation of pharmaceutically active ingredients with pharmaceutically acceptable carriers is known in the art, e.g., Remington: The Science and Practice of Pharmacy (e.g. 21st edition (2005), and any later editions). Non-limiting examples of additional ingredients include: buffers, diluents, solvents, tonicity regulating agents, preservatives, stabilizers, and chelating agents. One or more pharmaceutically acceptable carriers can be used in formulating the pharmaceutical compositions provided herein.

In one embodiment, the pharmaceutical composition is a liquid formulation. A preferred example of a liquid formulation is an aqueous formulation, i.e., a formulation comprising water. The liquid formulation can comprise a solution, a suspension, an emulsion, a microemulsion, a gel, and the like. An aqueous formulation typically comprises at least 50% w/w water, or at least 60%, 70%, 75%, 80%, 85%, 90%, or at least 95% w/w of water.

In one embodiment, the pharmaceutical composition can be formulated as an injectable which can be injected, for example, via an injection device (e.g., a syringe or an infusion pump). The injection can be delivered subcutaneously, intramuscularly, intraperitoneally, intravitreally, or intravenously, for example.

In another embodiment, the pharmaceutical composition is a solid formulation, e.g., a freeze-dried or spray-dried composition, which can be used as is, or whereto the physician or the patient adds solvents, and/or diluents prior to use. Solid dosage forms can include tablets, such as compressed tablets, and/or coated tablets, and capsules (e.g., hard or soft gelatin capsules). The pharmaceutical composition can also be in the form of sachets, dragees, powders, granules, lozenges, or powders for reconstitution, for example.

The dosage forms can be immediate release, in which case they can comprise a water-soluble or dispersible carrier, or they can be delayed release, sustained release, or modified release, in which case they can comprise water-insoluble polymers that regulate the rate of dissolution of the dosage form in the gastrointestinal tract or under the skin.

In other embodiments, the pharmaceutical composition can be delivered intranasally, intrabuccally, or sublingually.

The pH in an aqueous formulation can be between pH 3 and pH 10. In one embodiment, the pH of the formulation is from about 7.0 to about 9.5. In another embodiment, the pH of the formulation is from about 3.0 to about 7.0.

In another embodiment, the pharmaceutical composition comprises a buffer. Non-limiting examples of buffers include: arginine, aspartic acid, bicine, citrate, disodium hydrogen phosphate, fumaric acid, glycine, glycylglycine, histidine, lysine, maleic acid, malic acid, sodium acetate, sodium carbonate, sodium dihydrogen phosphate, sodium phosphate, succinate, tartaric acid, tricine, and tris(hydroxymethyl)-aminomethane, and mixtures thereof. The buffer can be present individually or in the aggregate, in a concentration from about 0.01 mg/ml to about 50 mg/ml, for example from about 0.1 mg/ml to about 20 mg/ml. Pharmaceutical compositions comprising each one of these specific buffers constitute alternative embodiments.

In another embodiment, the pharmaceutical composition comprises a preservative. Non-limiting examples of preservatives include: benzethonium chloride, benzoic acid, benzyl alcohol, bronopol, butyl 4-hydroxybenzoate, chlorobutanol, chlorocresol, chlorohexidine, chlorphenesin, o-cresol, m-cresol, p-cresol, ethyl 4-hydroxybenzoate, imidurea, methyl 4-hydroxybenzoate, phenol, 2-phenoxyethanol, 2-phenylethanol, propyl 4-hydroxybenzoate, sodium dehydroacetate, thiomerosal, and mixtures thereof. The preservative can be present individually or in the aggregate, in a concentration from about 0.01 mg/ml to about 50 mg/ml, for example from about 0.1 mg/ml to about 20 mg/ml. Pharmaceutical compositions comprising each one of these specific preservatives constitute alternative embodiments.

In another embodiment, the pharmaceutical composition comprises an isotonic agent. Non-limiting examples of isotonic agents include a salt (such as sodium chloride), an amino acid (such as glycine, histidine, arginine, lysine, isoleucine, aspartic acid, tryptophan, and threonine), an alditol (such as glycerol, 1,2-propanediol propyleneglycol), 1,3-propanediol, and 1,3-butanediol), polyethyleneglycol (e.g. PEG400), and mixtures thereof. Another example of an isotonic agent includes a sugar. Non-limiting examples of sugars can include mono-, di-, or polysaccharides, or water-soluble glucans, including for example fructose, glucose, mannose, sorbose, xylose, maltose, lactose, sucrose, trehalose, dextran, pullulan, dextrin, cyclodextrin, alpha and beta-HPCD, soluble starch, hydroxyethyl starch, and sodium carboxymethyl-cellulose. Another example of an isotonic agent is a sugar alcohol, wherein the term "sugar alcohol" is defined as a C(4-8) hydrocarbon having at least one —OH group. Non-limiting examples of sugar alcohols include mannitol, sorbitol, inositol, galactitol, dulcitol, xylitol, and arabitol. The isotonic agent can be present individually or in the aggregate, in a concentration from about 0.01 mg/ml to about 50 mg/ml, for example from about 0.1 mg/ml to about 20 mg/ml. Pharmaceutical compositions comprising each one of these specific isotonic agents constitute alternative embodiments.

In another embodiment, the pharmaceutical composition comprises a chelating agent. Non-limiting examples of chelating agents include citric acid, aspartic acid, salts of ethylenediaminetetraacetic acid (EDTA), and mixtures thereof. The chelating agent can be present individually or in the aggregate, in a concentration from about 0.01 mg/ml to about 50 mg/ml, for example from about 0.1 mg/ml to about 20 mg/ml. Pharmaceutical compositions comprising each one of these specific chelating agents constitute alternative embodiments.

In another embodiment, the pharmaceutical composition comprises a stabilizer. Non-limiting examples of stabilizers include one or more aggregation inhibitors, one or more oxidation inhibitors, one or more surfactants, and/or one or more protease inhibitors.

In another embodiment, the pharmaceutical composition comprises a stabilizer, wherein said stabilizer is carboxy-/hydroxycellulose and derivates thereof (such as HPC, HPC-SL, HPC-L and HPMC), cyclodextrins, 2-methylthioethanol, polyethylene glycol (such as PEG 3350), polyvinyl alcohol (PVA), polyvinyl pyrrolidone, salts (such as sodium chloride), sulphur-containing substances such as monothioglycerol), or thioglycolic acid. The stabilizer can be present individually or in the aggregate, in a concentration from about 0.01 mg/ml to about 50 mg/ml, for example from about 0.1 mg/ml to about 20 mg/ml. Pharmaceutical compositions comprising each one of these specific stabilizers constitute alternative embodiments.

In further embodiments, the pharmaceutical composition comprises one or more surfactants, preferably a surfactant, at least one surfactant, or two different surfactants. The term "surfactant" refers to any molecules or ions that are comprised of a water-soluble (hydrophilic) part, and a fat-soluble (lipophilic) part. The surfactant can, for example, be selected from the group consisting of anionic surfactants, cationic surfactants, nonionic surfactants, and/or zwitterionic surfactants. The surfactant can be present individually or in the aggregate, in a concentration from about 0.1 mg/ml to about 20 mg/ml. Pharmaceutical compositions comprising each one of these specific surfactants constitute alternative embodiments.

In a further embodiment, the pharmaceutical composition comprises one or more protease inhibitors, such as, e.g., EDTA, and/or benzamidine hydrochloric acid (HCl). The protease inhibitor can be present individually or in the aggregate, in a concentration from about 0.1 mg/ml to about 20 mg/ml. Pharmaceutical compositions comprising each one of these specific protease inhibitors constitute alternative embodiments.

In another general aspect, provided herein is a method of producing a pharmaceutical composition comprising an antibody or antigen-binding fragment thereof provided herein, comprising combining an antibody or antigen-binding fragment thereof with a pharmaceutically acceptable carrier to obtain the pharmaceutical composition.

Methods of Use

The functional activity of antibodies provided herein can be characterized by methods known in the art and as described herein. Methods for characterizing antibodies and antigen-binding fragments thereof include, but are not limited to, affinity and specificity assays including Biacore, ELISA, and OctetRed analysis; binding assays to detect the binding of antibodies to target cells by FACS; binding assays to detect the binding of antibodies to the target antigen on cells. According to particular embodiments, the methods for characterizing antibodies and antigen-binding fragments thereof include those described below. In certain embodiments, the antibody is a TRGV9 antibody. In certain embodiments, the antibody is a TRDV2 antibody. In certain embodiments, the antibody is a TRGDC antibody.

In one aspect, provided is a method of activating a T cell expressing TRGV9, comprising contacting the T cell with a TRGV9 antibody provided herein. In some embodiments, the contacting results in an increase in CD69, CD25, and/or Granzyme B expression, as compared to a control T cell expressing TRGV9.

In another general aspect, provided is a method of inactivating a T cell expressing TRGV9, comprising contacting the T cell with an antibody that binds to a TRGV9 provided herein. In another general aspect, provided is a method of blocking activation of a T cell expressing TRGV9, comprising contacting the T cell with an antibody that binds to a TRGV9 provided herein. In another general aspect, provided is a method of modulating the activation of a T cell expressing TRGV9, comprising contacting the T cell with an antibody that binds to a TRGV9 provided herein.

In another aspect, provided herein is a method of directing a T cell expressing TRGV9 to a target cell, the method comprising contacting the T cell with a multispecific TRGV9 antibody provided herein. In another aspect, provided herein is a method of directing a T cell expressing TRGV9 to a target cell, the method comprising contacting the T cell with a pharmaceutical composition comprising a multispecific TRGV9 antibody provided herein. In some embodiments, the contacting directs the T cell to the target cell. Also provided is a method of targeting an antigen on the surface of a target cell, the method comprising exposing the target cell to a TRGV9 multispecific antibody provided herein. Also provided is a method of targeting an antigen on the surface of a target cell, the method comprising exposing the target cell to a pharmaceutical composition comprising a TRGV9 multispecific antibody provided herein. In another general aspect, provided is a method of targeting an antigen on the surface of a target cell, the method comprising exposing the target cell to a TRGV9 multispecific antibody provided herein. In another general aspect, provided is a method of targeting an antigen on the surface of a target cell, the method comprising exposing the target cell to a pharmaceutical composition comprising a TRGV9 multispecific antibody provided herein.

Also provided herein is a method of treating a disease or disorder in a subject, comprising administering to the subject a TRGV9 antibody provided herein. Also provided herein is a method of treating a disease or disorder in a subject, comprising administering to the subject a TRGV9 antigen binding fragment provided herein. Also provided herein is a method of treating a disease or disorder in a subject, comprising administering to the subject a pharmaceutical composition comprising a TRGV9 antibody provided herein. Also provided herein is a method of treating a disease or disorder in a subject, comprising administering to the subject a pharmaceutical composition comprising a TRGV9 antigen binding fragment provided herein. In a specific embodiment, the disease or disorder is caused all or in part by target cells expressing the second target.

In some embodiments, also provided is a method of directing a γδ T cell to a target cell, the method comprising contacting the γδ T cell with a multispecific TRGV9 antibody provided herein. In some embodiments, also provided is a TRGV9 antibody provided herein for use in directing a γδ T cell to a target cell. In some embodiments, also provided is a TRGV9 multispecific antibody provided herein for use in the manufacture of a medicament for directing a γδ T cell to a target cell. In certain embodiments, the target cell expresses the second target. In some embodiments, the contacting directs the γδ T cell to the target cell.

In some embodiments, also provided is a method of inhibiting growth or proliferation of target cells, the method comprising contacting the target cells with a multispecific TRGV9 antibody provided herein. In some embodiments, also provided is a TRGV9 multispecific antibody provided herein for use in inhibiting growth or proliferation of target cells. In some embodiments, also provided is a TRGV9 multispecific antibody provided herein for use in the manufacture of a medicament for inhibiting growth or proliferation of target cells. In certain embodiments, the target cells express the second target on the cell surface. In specific embodiments, the contacting the target cells with the multispecific TRGV9 antibody inhibits growth or proliferation of the target cells. In certain embodiments, the target cells are in the presence of a T cell expressing TRGV9 while in contact with the multispecific antibody. In a specific embodiment, the T cell expressing TRGV9 is a γδ T cell.

In some embodiments, also provided is a method for eliminating target cells in a subject, comprising administering an effective amount of a multispecific TRGV9 antibody provided herein to the subject. In some embodiments, also provided is a multispecific TRGV9 antibody provided herein for use in eliminating target cells in a subject. In some embodiments, also provided is a TRGV9 multispecific antibody provided herein for use in the manufacture of a medicament for the elimination of target cells in a subject. In some embodiments, the target cells express the second target on the cell surface. In certain embodiments, the target cells are in the presence of a T cell expressing TRGV9 in the subject. In a specific embodiment, the T cell expressing TRGV9 is a γδ T cell. In a specific embodiment, the subject is a subject in need thereof.

In some embodiments, also is a method for treating a disease caused all or in part by target cells in a subject, comprising administering an effective amount of a multispecific TRGV9 antibody provided herein to the subject. In some embodiments, also is a TRGV9 multispecific antibody for use in the treatment of a disease caused all or in part by target cells in a subject. In some embodiments, also provided is a TRGV9 multispecific antibody provided herein for use in the manufacture of a medicament for the treatment of a disease caused all or in part by target cells in a subject. In some embodiments, the target cells express the second target on the cell surface. In certain embodiments, the target cells are in the presence of a T cell expressing TRGV9 in the subject. In a specific embodiment, the T cell expressing TRGV9 is a γδ T cell. In a specific embodiment, the subject is a subject in need thereof. In some embodiments, the second target is a cancer antigen. In some embodiments, the second target is a tumor associated antigen.

Also provided is a method of activating a T cell expressing TRDV2, comprising contacting the T cell with a TRDV2 antibody provided herein. In some embodiments, the contacting results in an increase in CD69, CD25, and/or Granzyme B expression, as compared to a control T cell expressing TRDV2.

In another general aspect, provided is a method of inactivating a T cell expressing TRDV2, comprising contacting the T cell with an antibody that binds to a TRDV2 provided herein. In another general aspect, provided is a method of blocking activation of a T cell expressing TRDV2, comprising contacting the T cell with an antibody that binds to a TRDV2 provided herein. In another general aspect, provided is a method of modulating the activation of a T cell expressing TRDV2, comprising contacting the T cell with an antibody that binds to a TRDV2 provided herein.

In another aspect, provided herein is a method of directing a T cell expressing TRDV2 to a target cell, the method comprising contacting the T cell with a multispecific TRDV2 antibody provided herein. In another aspect, provided herein is a method of directing a T cell expressing TRDV2 to a target cell, the method comprising contacting the T cell with a pharmaceutical composition comprising a multispecific TRDV2 antibody provided herein. In some embodiments, the contacting directs the T cell to the target cell. Also provided is a method of targeting an antigen on the surface of a target cell, the method comprising exposing the target cell to a TRDV2 multispecific antibody provided herein. Also provided is a method of targeting an antigen on the surface of a target cell, the method comprising exposing the target cell to a pharmaceutical composition comprising a TRDV2 multispecific antibody provided herein. In another general aspect, provided is a method of targeting an antigen on the surface of a target cell, the method comprising exposing the target cell to a TRDV2 multispecific antibody provided herein. In another general aspect, provided is a method of targeting an antigen on the surface of a target cell, the method comprising exposing the target cell to a pharmaceutical composition comprising a TRDV2 multispecific antibody provided herein.

Also provided herein is a method of treating a disease or disorder in a subject, comprising administering to the subject a TRDV2 antibody provided herein. Also provided herein is a method of treating a disease or disorder in a subject, comprising administering to the subject a TRDV2 antigen binding fragment provided herein. Also provided herein is a method of treating a disease or disorder in a subject, comprising administering to the subject a pharmaceutical composition comprising a TRDV2 antibody provided herein. Also provided herein is a method of treating a disease or disorder in a subject, comprising administering to the subject a pharmaceutical composition comprising a TRDV2 antigen binding fragment provided herein. In a specific embodiment, the disease or disorder is caused all or in part by target cells expressing the second target.

In some embodiments, also provided is a method of directing a γδ T cell to a target cell, the method comprising contacting the γδ T cell with a multispecific TRDV2 antibody provided herein. In some embodiments, also provided is a TRDV2 antibody provided herein for use in directing a γδ T cell to a target cell. In some embodiments, also provided is a TRDV2 multispecific antibody provided herein for use in the manufacture of a medicament for directing a γδ T cell to a target cell. In certain embodiments, the target cell expresses the second target. In some embodiments, the contacting directs the γδ T cell to the target cell.

In some embodiments, also provided is a method of inhibiting growth or proliferation of target cells, the method comprising contacting the target cells with a multispecific TRDV2 antibody provided herein. In some embodiments, also provided is a TRDV2 multispecific antibody provided herein for use in inhibiting growth or proliferation of target cells. In some embodiments, also provided is a TRDV2 multispecific antibody provided herein for use in the manufacture of a medicament for inhibiting growth or proliferation of target cells. In certain embodiments, the target cells express the second target on the cell surface. In specific embodiments, the contacting the target cells with the multispecific TRDV2 antibody inhibits growth or proliferation of the target cells. In certain embodiments, the target cells are in the presence of a T cell expressing TRDV2 while in contact with the multispecific antibody. In a specific embodiment, the T cell expressing TRDV2 is a γδ T cell.

In some embodiments, also provided is a method for eliminating target cells in a subject, comprising administering an effective amount of a multispecific TRDV2 antibody provided herein to the subject. In some embodiments, also provided is a multispecific TRDV2 antibody provided herein for use in eliminating target cells in a subject. In some embodiments, also provided is a TRDV2 multispecific antibody provided herein for use in the manufacture of a medicament for the elimination of target cells in a subject. In some embodiments, the target cells express the second target on the cell surface. In certain embodiments, the target cells are in the presence of a T cell expressing TRDV2 in the subject. In a specific embodiment, the T cell expressing TRDV2 is a γδ T cell. In a specific embodiment, the subject is a subject in need thereof.

In some embodiments, also is a method for treating a disease caused all or in part by target cells in a subject, comprising administering an effective amount of a multispecific TRDV2 antibody provided herein to the subject. In some embodiments, also is a TRDV2 multispecific antibody for use in the treatment of a disease caused all or in part by target cells in a subject. In some embodiments, also provided is a TRDV2 multispecific antibody provided herein for use in the manufacture of a medicament for the treatment of a disease caused all or in part by target cells in a subject. In some embodiments, the target cells express the second target on the cell surface. In certain embodiments, the target cells are in the presence of a T cell expressing TRDV2 in the subject. In a specific embodiment, the T cell expressing TRDV2 is a γδ T cell. In a specific embodiment, the subject is a subject in need thereof. In some embodiments, the second target is a cancer antigen. In some embodiments, the second target is a tumor associated antigen.

Also provided is a method of activating a T cell expressing TRGDC, comprising contacting the T cell with a TRGDC antibody provided herein. In some embodiments, the contacting results in an increase in CD69, CD25, and/or Granzyme B expression, as compared to a control T cell expressing TRGDC.

In another general aspect, provided is a method of inactivating a T cell expressing TRGDC, comprising contacting the T cell with an antibody that binds to a TRGDC provided herein. In another general aspect, provided is a method of blocking activation of a T cell expressing TRGDC, comprising contacting the T cell with an antibody that binds to a TRGDC provided herein. In another general aspect, provided is a method of modulating the activation of a T cell expressing TRGDC, comprising contacting the T cell with an antibody that binds to a TRGDC provided herein.

In another aspect, provided herein is a method of directing a T cell expressing TRGDC to a target cell, the method comprising contacting the T cell with a multispecific TRGDC antibody provided herein. In another aspect, provided herein is a method of directing a T cell expressing TRGDC to a target cell, the method comprising contacting the T cell with a pharmaceutical composition comprising a multispecific TRGDC antibody provided herein. In some embodiments, the contacting directs the T cell to the target cell. Also provided is a method of targeting an antigen on the surface of a target cell, the method comprising exposing the target cell to a TRGDC multispecific antibody provided herein. Also provided is a method of targeting an antigen on the surface of a target cell, the method comprising exposing the target cell to a pharmaceutical composition comprising a TRGDC multispecific antibody provided herein. In another general aspect, provided is a method of targeting an antigen on the surface of a target cell, the method comprising exposing the target cell to a TRGDC multispecific antibody provided herein. In another general aspect, provided is a method of targeting an antigen on the surface of a target cell, the method comprising exposing the target cell to a pharmaceutical composition comprising a TRGDC multispecific antibody provided herein.

Also provided herein is a method of treating a disease or disorder in a subject, comprising administering to the subject a TRGDC antibody provided herein. Also provided herein is a method of treating a disease or disorder in a subject, comprising administering to the subject a TRGDC antigen binding fragment provided herein. Also provided herein is a method of treating a disease or disorder in a subject, comprising administering to the subject a pharmaceutical composition comprising a TRGDC antibody provided herein. Also provided herein is a method of treating a disease or disorder in a subject, comprising administering to the subject a pharmaceutical composition comprising a TRGDC antigen binding fragment provided herein. In a specific embodiment, the disease or disorder is caused all or in part by target cells expressing the second target.

In some embodiments, also provided is a method of directing a γδ T cell to a target cell, the method comprising contacting the γδ T cell with a multispecific TRGDC antibody provided herein. In some embodiments, also provided is a TRGDC antibody provided herein for use in directing a γδ T cell to a target cell. In some embodiments, also provided is a TRGDC multispecific antibody provided herein for use in the manufacture of a medicament for directing a γδ T cell to a target cell. In certain embodiments, the target cell expresses the second target. In some embodiments, the contacting directs the γδ T cell to the target cell.

In some embodiments, also provided is a method of inhibiting growth or proliferation of target cells, the method comprising contacting the target cells with a multispecific TRGDC antibody provided herein. In some embodiments, also provided is a TRGDC multispecific antibody provided herein for use in inhibiting growth or proliferation of target cells. In some embodiments, also provided is a TRGDC multispecific antibody provided herein for use in the manufacture of a medicament for inhibiting growth or proliferation of target cells. In certain embodiments, the target cells express the second target on the cell surface. In specific embodiments, the contacting the target cells with the multispecific TRGDC antibody inhibits growth or proliferation of the target cells. In certain embodiments, the target cells are in the presence of a T cell expressing TRGDC while in contact with the multispecific antibody. In a specific embodiment, the T cell expressing TRGDC is a γδ T cell.

In some embodiments, also provided is a method for eliminating target cells in a subject, comprising administering an effective amount of a multispecific TRGDC antibody provided herein to the subject. In some embodiments, also provided is a multispecific TRGDC antibody provided herein for use in eliminating target cells in a subject. In some embodiments, also provided is a TRGDC multispecific antibody provided herein for use in the manufacture of a medicament for the elimination of target cells in a subject. In some embodiments, the target cells express the second target on the cell surface. In certain embodiments, the target cells are in the presence of a T cell expressing TRGDC in the subject. In a specific embodiment, the T cell expressing TRGDC is a γδ T cell. In a specific embodiment, the subject is a subject in need thereof.

In some embodiments, also is a method for treating a disease caused all or in part by target cells in a subject, comprising administering an effective amount of a multispecific TRGDC antibody provided herein to the subject. In some embodiments, also is a TRGDC multispecific antibody for use in the treatment of a disease caused all or in part by target cells in a subject. In some embodiments, also provided is a TRGDC multispecific antibody provided herein for use in the manufacture of a medicament for the treatment of a disease caused all or in part by target cells in a subject. In some embodiments, the target cells express the second target on the cell surface. In certain embodiments, the target cells are in the presence of a T cell expressing TRGDC in the subject. In a specific embodiment, the T cell expressing TRGDC is a γδ T cell. In a specific embodiment, the subject is a subject in need thereof. In some embodiments, the second target is a cancer antigen. In some embodiments, the second target is a tumor associated antigen.

In some embodiments, the subject is a subject in need thereof. In some embodiments, the subject is a human. In specific embodiments, the subject is administered an effective amount.

As used herein, the term "effective amount" refers to an amount of an active ingredient or component that elicits the desired biological or medicinal response in a subject.

According to particular embodiments, an effective amount refers to the amount of therapy which is sufficient to achieve one, two, three, four, or more of the following effects: (i) reduce or ameliorate the severity of the disease, disorder or condition to be treated or a symptom associated therewith; (ii) reduce the duration of the disease, disorder or condition to be treated, or a symptom associated therewith; (iii) prevent the progression of the disease, disorder or condition to be treated, or a symptom associated therewith; (iv) cause regression of the disease, disorder or condition to be treated, or a symptom associated therewith; (v) prevent the development or onset of the disease, disorder or condition to be treated, or a symptom associated therewith; (vi) prevent the recurrence of the disease, disorder or condition to be treated, or a symptom associated therewith; (vii) reduce hospitalization of a subject having the disease, disorder or condition to be treated, or a symptom associated therewith; (viii) reduce hospitalization length of a subject having the disease, disorder or condition to be treated, or a symptom associated therewith; (ix) increase the survival of a subject with the disease, disorder or condition to be treated, or a symptom associated therewith; (xi) inhibit or reduce the disease, disorder or condition to be treated, or a symptom associated therewith in a subject; and/or (xii) enhance or improve the prophylactic or therapeutic effect(s) of another therapy.

The effective amount or dosage can vary according to various factors, such as the disease, disorder or condition to be treated, the means of administration, the target site, the physiological state of the subject (including, e.g., age, body weight, health), whether the subject is a human or an animal, other medications administered, and whether the treatment is prophylactic or therapeutic. Treatment dosages are optimally titrated to optimize safety and efficacy.

According to particular embodiments, the compositions described herein are formulated to be suitable for the intended route of administration to a subject. For example, the compositions described herein can be formulated to be suitable for intravenous, subcutaneous, or intramuscular administration.

As used herein, the terms "treat," "treating," and "treatment" are all intended to refer to an amelioration or reversal of at least one measurable physical parameter related to a cancer, which is not necessarily discernible in the subject, but can be discernible in the subject. The terms "treat," "treating," and "treatment," can also refer to causing regression, preventing the progression, or at least slowing down the progression of the disease, disorder, or condition. In a particular embodiment, "treat," "treating," and "treatment" refer to an alleviation, prevention of the development or onset, or reduction in the duration of one or more symptoms associated with the disease, disorder, or condition, such as a tumor or more preferably a cancer. In a particular embodiment, "treat," "treating," and "treatment" refer to prevention of the recurrence of the disease, disorder, or condition. In a particular embodiment, "treat," "treating," and "treatment" refer to an increase in the survival of a subject having the disease, disorder, or condition. In a particular embodiment, "treat," "treating," and "treatment" refer to elimination of the disease, disorder, or condition in the subject.

In some embodiments, a TRGV9 antibody provided herein is used in combination with a supplemental therapy. In some embodiments, a TRDV2 antibody provided herein is used in combination with a supplemental therapy.

In some embodiments, a TRGDC antibody provided herein is used in combination with a supplemental therapy.

As used herein, the term "in combination," in the context of the administration of two or more therapies to a subject, refers to the use of more than one therapy. The use of the term "in combination" does not restrict the order in which therapies are administered to a subject. For example, a first therapy (e.g., a composition described herein) can be administered prior to (e.g., 5 minutes, 15 minutes, 30 minutes, 45 minutes, 1 hour, 2 hours, 4 hours, 6 hours, 12 hours, 16 hours, 24 hours, 48 hours, 72 hours, 96 hours, 1 week, 2 weeks, 3 weeks, 4 weeks, 5 weeks, 6 weeks, 8 weeks, or 12 weeks before), concomitantly with, or subsequent to (e.g., 5 minutes, 15 minutes, 30 minutes, 45 minutes, 1 hour, 2 hours, 4 hours, 6 hours, 12 hours, 16 hours, 24 hours, 48 hours, 72 hours, 96 hours, 1 week, 2 weeks, 3 weeks, 4 weeks, 5 weeks, 6 weeks, 8 weeks, or 12 weeks after) the administration of a second therapy to a subject.

TRGV9 antibodies provided herein may also be used as agents to detect TRGV9-expressing cells. Thus, in another methods, provided is a method of detecting a cell expressing TRGV9, comprising contacting a cell with a TRGV9 antibody provided herein. In certain embodiments, the detecting is by ELISA. In some embodiments, the detecting is by FACS analysis. Also provided are kits comprising a TRGV9 antibody provided herein, and instructions for use.

TRDV2 antibodies provided herein may also be used as agents to detect TRDV2-expressing cells. Thus, in another methods, provided is a method of detecting a cell expressing TRDV2, comprising contacting a cell with a TRDV2 antibody provided herein. In certain embodiments, the detecting is by ELISA. In some embodiments, the detecting is by FACS analysis. Also provided are kits comprising a TRDV2 antibody provided herein, and instructions for use.

TRGDC antibodies provided herein may also be used as agents to detect TRGDC-expressing cells. Thus, in another methods, provided is a method of detecting a cell expressing TRGDC, comprising contacting a cell with a TRGDC antibody provided herein. In certain embodiments, the detecting is by ELISA. In some embodiments, the detecting is by FACS analysis. Also provided are kits comprising a TRGDC antibody provided herein, and instructions for use.

Enrichment and Detection Methods

In one aspect, the TRGV9 antibodies provided herein are used as agents to detect TRGV9-expressing cells. Thus, in other methods, provided is a method of detecting a cell expressing TRGV9, comprising contacting a cell with a TRGV9 antibody provided herein. In certain embodiments, the detecting is by ELISA. In some embodiments, the detecting is by FACS analysis. Also provided are kits comprising a TRGV9 antibody provided herein, and instructions for use.

Enrichment, isolation, separation, purification, sorting, selecting, capturing or detecting, or any combination thereof can be done using known technologies such as bead, microfluidics, solid support, columns, and the like. For example, TRGV9 cells may be separated or visualized using known methods when bound to the TRGV9 antibodies provided herein.

The TRGV9 antibodies or multispecific TRGV9 antibodies provided herein can be used to selectively enrich, isolate, separate, purify, sort, select, capture or detect TRGV9-expressing cells. The TRGV9 antibodies or multispecific TRGV9 antibodies provided herein may be utilized in a bispecific format, e.g. containing a first antigen binding domain that specifically binds TRGV9 and a second antigen binding domain that specifically binds a second target. In other embodiments, the multispecific TRGV9 antibodies provided herein may be utilized in a format that further incorporates a third antigen binding domain that specifically binds a third antigen (e.g., at a trispecific antibody). In other embodiments, the multispecific TRGV9 antibodies provided herein may be utilized in a format that further incorporates a fourth antigen binding domain that specifically binds a fourth antigen. (e.g., as a quadraspecific antibody).

In one aspect, provided herein is a method of enriching a TRGV9-expressing cell comprising: providing a sample comprising the TRGV9-expressing cell; contacting the sample with a TRGV9 antibody provided herein; and enriching the TRGV9-expressing cell bound to the TRGV9 antibody. In one aspect, provided herein is a method of isolating a TRGV9-expressing cell comprising: providing a sample comprising the TRGV9-expressing cell; contacting the sample with a TRGV9 antibody provided herein; and isolating the TRGV9-expressing cell bound to the TRGV9 antibody. In one aspect, provided herein is a method of separating a TRGV9-expressing cell comprising: providing a sample comprising the TRGV9-expressing cell; contacting the sample with a TRGV9 antibody provided herein; and separating the TRGV9-expressing cell bound to the TRGV9 antibody. In one aspect, provided herein is a method of purifying a TRGV9-expressing cell comprising: providing a sample comprising the TRGV9-expressing cell; contacting the sample with a TRGV9 antibody provided herein; and purifying the TRGV9-expressing cell bound to the TRGV9 antibody. In one aspect, provided herein is a method of sorting a TRGV9-expressing cell comprising: providing a sample comprising the TRGV9-expressing cell; contacting the sample with a TRGV9 antibody provided herein; and sorting the TRGV9-expressing cell bound to the TRGV9 antibody. In one aspect, provided herein is a method of selecting a TRGV9-expressing cell comprising: providing a sample comprising the TRGV9-expressing cell; contacting the sample with a TRGV9 antibody provided herein; and selecting the TRGV9-expressing cell bound to the TRGV9 antibody. In one aspect, provided herein is a method of capturing a TRGV9-expressing cell comprising: providing a sample comprising the TRGV9-expressing cell; contacting the sample with a TRGV9 antibody provided herein; and capturing the TRGV9-expressing cell bound to the TRGV9 antibody. In one aspect, provided herein is a method of detecting a TRGV9-expressing cell comprising: providing a sample comprising the TRGV9-expressing cell; contacting the sample with a TRGV9 antibody provided herein; and detecting the TRGV9-expressing cell bound to the TRGV9 antibody.

In one aspect, provided herein is a method of enriching a TRGV9-expressing cell comprising: contacting a TRGV9-expressing cell with a TRGV9 antibody provided herein; and enriching the TRGV9-expressing cell bound to the TRGV9 antibody. In one aspect, provided herein is a method of isolating a TRGV9-expressing cell comprising: contacting a TRGV9-expressing cell with a TRGV9 antibody provided herein; and isolating the TRGV9-expressing cell bound to the TRGV9 antibody. In one aspect, provided herein is a method of separating a TRGV9-expressing cell comprising: contacting a TRGV9-expressing cell with a TRGV9 antibody provided herein; and separating the TRGV9-expressing cell bound to the TRGV9 antibody. In one aspect, provided herein is a method of purifying a TRGV9-expressing cell comprising: contacting a TRGV9-expressing cell with a TRGV9 antibody provided herein; and purifying the TRGV9-expressing cell bound to the TRGV9 antibody. In one aspect, provided herein is a method of sorting a TRGV9-expressing cell comprising: contacting a TRGV9-expressing cell with a TRGV9 antibody provided herein; and sorting the TRGV9-expressing cell bound to the TRGV9 antibody. In one aspect, provided herein is a method of selecting a TRGV9-expressing cell comprising: contacting a TRGV9-expressing cell with a TRGV9 antibody provided herein; and selecting the TRGV9-expressing cell bound to the TRGV9 antibody. In one aspect, provided herein is a method of capturing a TRGV9-expressing cell comprising: contacting a TRGV9-expressing cell with a TRGV9 antibody provided herein; and capturing the TRGV9-expressing cell bound to the TRGV9 antibody. In one aspect, provided herein is a method of detecting a TRGV9-expressing cell comprising: contacting a TRGV9-expressing cell with a TRGV9 antibody provided herein; and detecting the TRGV9-expressing cell bound to the TRGV9 antibody.

In one aspect, provided herein is a method of enriching a TRGV9-expressing cell comprising: contacting a TRGV9-expressing cell with a TRGV9 antibody provided herein; and enriching the TRGV9-expressing cell based on binding of the TRGV9-expressing cell to the TRGV9 antibody. In one aspect, provided herein is a method of isolating a TRGV9-expressing cell comprising: contacting a TRGV9-expressing cell with a TRGV9 antibody provided herein; and isolating the TRGV9-expressing cell based on binding of the TRGV9-expressing cell to the TRGV9 antibody. In one aspect, provided herein is a method of separating a TRGV9-expressing cell comprising: contacting a TRGV9-expressing cell with a TRGV9 antibody provided herein; and separating the TRGV9-expressing cell based on binding of the TRGV9-expressing cell to the TRGV9 antibody. In one aspect, provided herein is a method of purifying a TRGV9-expressing cell comprising: contacting a TRGV9-expressing cell with a TRGV9 antibody provided herein; and purifying the TRGV9-expressing cell based on binding of the TRGV9-expressing cell to the TRGV9 antibody. In one aspect, provided herein is a method of sorting a TRGV9-expressing cell comprising: contacting a TRGV9-expressing cell with a TRGV9 antibody provided herein; and sorting the TRGV9-expressing cell based on binding of the TRGV9-expressing cell to the TRGV9 antibody. In one aspect, provided herein is a method of selecting a TRGV9-expressing cell comprising: contacting a TRGV9-expressing cell with a TRGV9 antibody provided herein; and selecting the TRGV9-expressing cell based on binding of the TRGV9-expressing cell to the TRGV9 antibody. In one aspect, provided herein is a method of capturing a TRGV9-expressing cell comprising: contacting a TRGV9-expressing cell with a TRGV9 antibody provided herein; and capturing the TRGV9-expressing cell based on binding of the TRGV9-expressing cell to the TRGV9 antibody. In one aspect, provided herein is a method of detecting a TRGV9-expressing cell comprising: contacting a TRGV9-expressing cell with a TRGV9 antibody provided herein; and detecting the TRGV9-expressing cell based on binding of the TRGV9-expressing cell to the TRGV9 antibody.

In certain embodiments of the methods, the TRGV9-expressing cell is a T cell. In some embodiments of the methods, the TRGV9-expressing cell is in a population of cells. In some embodiments of the methods, the TRGV9-expressing cell is in a population of lymphocytes. In some embodiments of the methods, the TRGV9-expressing cell is in a population of T cells. In some embodiments of the methods, the TRGV9-expressing cell is provided as a population of cells. In some embodiments of the methods, the TRGV9-expressing cell is provided as a population of lymphocytes. In some embodiments of the methods, the TRGV9-expressing cell is provided as a population of T cells. In some embodiments of the methods, the TRGV9-expressing cell is provided as a sample comprising a population of cells. In some embodiments of the methods, the TRGV9-expressing cell is provided as a sample comprising a population of lymphocytes. In some embodiments of the methods, the TRGV9-expressing cell is provided as a sample comprising a population of T cells. In some embodiments of the methods, the sample is a blood sample. In some embodiments of the methods, the sample is a tissue sample. In some embodiments of the methods, the sample is a tissue culture sample.

In some embodiments of the methods, the TRGV9 antibody is a multispecific TRGV9 antibody provided herein. In some embodiments of the methods, the TRGV9 antibody is a bispecific TRGV9 antibody provided herein. In some embodiments of the methods, the TRGV9 antibody is a trispecific TRGV9 antibody provided herein. In some embodiments of the methods, the TRGV9 antibody is a quadraspecific TRGV9 antibody provided herein. In certain embodiments, the TRGV9 antibody specifically binds to TRGV9. In one embodiment, the multispecific TRGV9 antibody comprises: (a) a first binding domain that binds TRGV9, and (b) a second binding domain that binds to a second target. In one embodiment, the multispecific TRGV9 antibody comprises: (a) a first binding domain that binds TRGV9, and (b) a second binding domain that binds to a second target, and (c) a third binding domain that binds to a third target. In one embodiment, the multispecific TRGV9 antibody comprises: (a) a first binding domain that binds TRGV9, and (b) a second binding domain that binds to a second target, (c) a third binding domain that binds to a third target, and (d) a fourth binding domain that binds to a fourth target. In one embodiment, the multispecific TRGV9 antibody comprises: (a) a first binding domain that specifically binds TRGV9, and (b) a second binding domain that specifically binds to a second target. In one embodiment, the multispecific TRGV9 antibody comprises: (a) a first binding domain that specifically binds TRGV9, and (b) a second binding domain that specifically binds to a second target, and (c) a third binding domain that specifically binds to a third target. In one embodiment, the multispecific TRGV9 antibody comprises: (a) a first binding domain that specifically binds TRGV9, and (b) a second binding domain that specifically binds to a second target, (c) a third binding domain that specifically binds to a third target, and (d) a fourth binding domain that specifically binds to a fourth target.

In specific embodiments of the methods provided herein, the method uses multi-marker detection. In some embodiments, the multi-marker detection uses a multispecific TRGV9 antibody provided herein. In some embodiments, the multi-marker detection uses a bispecific TRGV9 antibody provided herein. In some embodiments, the multi-marker detection uses a trispecific TRGV9 antibody provided herein. In some embodiments, the multi-marker detection uses a quadraspecific TRGV9 antibody provided herein.

In certain embodiments of the methods provided herein, the methods are included as steps in a T cell manufacturing process. In certain embodiments, the cells are CAR-T cells. In certain embodiments of the methods provided herein, the methods are included as steps in a T cell modification process.

In certain embodiments of the methods provided herein, the methods are included as steps in a diagnostic method. In certain embodiments of the methods provided herein, the methods are included as steps in a method to quantify the TRGV9-expressing T cells.

In certain embodiments of the methods provided herein, the method further comprises expanding the enriched, isolated, separated, purified, sorted, selected, captured or detected TRGV9-expressing cells. In certain embodiments, the expanding is in vitro. In certain embodiments, the expanding is in vivo. In certain embodiments of the methods provided herein, the method further comprises growing the enriched, isolated, separated, purified, sorted, selected, captured or detected TRGV9-expressing cells. In certain embodiments, the growing is in vitro. In certain embodiments, the growing is in vivo. In certain embodiments of the methods provided herein, the method further comprises quantifying the enriched, isolated, separated, purified, sorted, selected, captured or detected TRGV9-expressing cells.

In one aspect, the TRDV2 antibodies provided herein are used as agents to detect TRDV2-expressing cells. Thus, in other methods, provided is a method of detecting a cell expressing TRDV2, comprising contacting a cell with a TRDV2 antibody provided herein. In certain embodiments, the detecting is by ELISA. In some embodiments, the detecting is by FACS analysis. Also provided are kits comprising a TRDV2 antibody provided herein, and instructions for use.

Enrichment, isolation, separation, purification, sorting, selecting, capturing or detecting, or any combination thereof can be done using known technologies such as bead, microfluidics, solid support, columns, and the like. For example, TRDV2 cells may be separated or visualized using known methods when bound to the TRDV2 antibodies provided herein.

The TRDV2 antibodies or multispecific TRDV2 antibodies provided herein can be used to selectively enrich, isolate, separate, purify, sort, select, capture or detect TRDV2-expressing cells. The TRDV2 antibodies or multispecific TRDV2 antibodies provided herein may be utilized in a bispecific format, e.g. containing a first antigen binding domain that specifically binds TRDV2 and a second antigen binding domain that specifically binds a second target. In other embodiments, the multispecific TRDV2 antibodies provided herein may be utilized in a format that further incorporates a third antigen binding domain that specifically binds a third antigen (e.g., at a trispecific antibody). In other embodiments, the multispecific TRDV2 antibodies provided herein may be utilized in a format that further incorporates a fourth antigen binding domain that specifically binds a fourth antigen. (e.g., as a quadraspecific antibody).

In one aspect, provided herein is a method of enriching a TRDV2-expressing cell comprising: providing a sample comprising the TRDV2-expressing cell; contacting the sample with a TRDV2 antibody provided herein; and enriching the TRDV2-expressing cell bound to the TRDV2 antibody. In one aspect, provided herein is a method of isolating a TRDV2-expressing cell comprising: providing a sample comprising the TRDV2-expressing cell; contacting the sample with a TRDV2 antibody provided herein; and isolating the TRDV2-expressing cell bound to the TRDV2 antibody. In one aspect, provided herein is a method of separating a TRDV2-expressing cell comprising: providing a sample comprising the TRDV2-expressing cell; contacting the sample with a TRDV2 antibody provided herein; and separating the TRDV2-expressing cell bound to the TRDV2 antibody. In one aspect, provided herein is a method of purifying a TRDV2-expressing cell comprising: providing a sample comprising the TRDV2-expressing cell; contacting the sample with a TRDV2 antibody provided herein; and purifying the TRDV2-expressing cell bound to the TRDV2 antibody. In one aspect, provided herein is a method of sorting a TRDV2-expressing cell comprising: providing a sample comprising the TRDV2-expressing cell; contacting the sample with a TRDV2 antibody provided herein; and sorting the TRDV2-expressing cell bound to the TRDV2 antibody. In one aspect, provided herein is a method of selecting a TRDV2-expressing cell comprising: providing a sample comprising the TRDV2-expressing cell; contacting the sample with a TRDV2 antibody provided herein; and selecting the TRDV2-expressing cell bound to the TRDV2 antibody. In one aspect, provided herein is a method of capturing a TRDV2-expressing cell comprising: providing a sample comprising the TRDV2-expressing cell; contacting the sample with a TRDV2 antibody provided herein; and capturing the TRDV2-expressing cell bound to the TRDV2 antibody. In one aspect, provided herein is a method of detecting a TRDV2-expressing cell comprising: providing a sample comprising the TRDV2-expressing cell; contacting the sample with a TRDV2 antibody provided herein; and detecting the TRDV2-expressing cell bound to the TRDV2 antibody.

In one aspect, provided herein is a method of enriching a TRDV2-expressing cell comprising: contacting a TRDV2-expressing cell with a TRDV2 antibody provided herein; and enriching the TRDV2-expressing cell bound to the TRDV2 antibody. In one aspect, provided herein is a method of isolating a TRDV2-expressing cell comprising: contacting a TRDV2-expressing cell with a TRDV2 antibody provided herein; and isolating the TRDV2-expressing cell bound to the TRDV2 antibody. In one aspect, provided herein is a method of separating a TRDV2-expressing cell comprising: contacting a TRDV2-expressing cell with a TRDV2 antibody provided herein; and separating the TRDV2-expressing cell bound to the TRDV2 antibody. In one aspect, provided herein is a method of purifying a TRDV2-expressing cell comprising: contacting a TRDV2-expressing cell with a TRDV2 antibody provided herein; and purifying the TRDV2-expressing cell bound to the TRDV2 antibody. In one aspect, provided herein is a method of sorting a TRDV2-expressing cell comprising: contacting a TRDV2-expressing cell with a TRDV2 antibody provided herein; and sorting the TRDV2-expressing cell bound to the TRDV2 antibody. In one aspect, provided herein is a method of selecting a TRDV2-expressing cell comprising: contacting a TRDV2-expressing cell with a TRDV2 antibody provided herein; and selecting the TRDV2-expressing cell bound to the TRDV2 antibody. In one aspect, provided herein is a method of capturing a TRDV2-expressing cell comprising: contacting a TRDV2-expressing cell with a TRDV2 antibody provided herein; and capturing the TRDV2-expressing cell bound to the TRDV2 antibody. In one aspect, provided herein is a method of detecting a TRDV2-expressing cell comprising: contacting a TRDV2-expressing cell with a TRDV2 antibody provided herein; and detecting the TRDV2-expressing cell bound to the TRDV2 antibody.

In one aspect, provided herein is a method of enriching a TRDV2-expressing cell comprising: contacting a TRDV2-expressing cell with a TRDV2 antibody provided herein; and enriching the TRDV2-expressing cell based on binding of the TRDV2-expressing cell to the TRDV2 antibody. In one aspect, provided herein is a method of isolating a TRDV2-expressing cell comprising: contacting a TRDV2-expressing cell with a TRDV2 antibody provided herein; and isolating the TRDV2-expressing cell based on binding of the TRDV2-expressing cell to the TRDV2 antibody. In one aspect, provided herein is a method of separating a TRDV2-expressing cell comprising: contacting a TRDV2-expressing cell with a TRDV2 antibody provided herein; and separating the TRDV2-expressing cell based on binding of the TRDV2-expressing cell to the TRDV2 antibody. In one aspect, provided herein is a method of purifying a TRDV2-expressing cell comprising: contacting a TRDV2-expressing cell with a TRDV2 antibody provided herein; and purifying the TRDV2-expressing cell based on binding of the TRDV2-expressing cell to the TRDV2 antibody. In one aspect, provided herein is a method of sorting a TRDV2-expressing cell comprising: contacting a TRDV2-expressing cell with a TRDV2 antibody provided herein; and sorting the TRDV2-expressing cell based on binding of the TRDV2-expressing cell to the TRDV2 antibody. In one aspect, provided herein is a method of selecting a TRDV2-expressing cell comprising: contacting a TRDV2-expressing cell with a TRDV2 antibody provided herein; and selecting the TRDV2-expressing cell based on binding of the TRDV2-expressing cell to the TRDV2 antibody. In one aspect, provided herein is a method of capturing a TRDV2-expressing cell comprising: contacting a TRDV2-expressing cell with a TRDV2 antibody provided herein; and capturing the TRDV2-expressing cell based on binding of the TRDV2-expressing cell to the TRDV2 antibody. In one aspect, provided herein is a method of detecting a TRDV2-expressing cell comprising: contacting a TRDV2-expressing cell with a TRDV2 antibody provided herein; and detecting the TRDV2-expressing cell based on binding of the TRDV2-expressing cell to the TRDV2 antibody.

In certain embodiments of the methods, the TRDV2-expressing cell is a T cell. In some embodiments of the methods, the TRDV2-expressing cell is in a population of cells. In some embodiments of the methods, the TRDV2-expressing cell is in a population of lymphocytes. In some embodiments of the methods, the TRDV2-expressing cell is in a population of T cells. In some embodiments of the methods, the TRDV2-expressing cell is provided as a population of cells. In some embodiments of the methods, the TRDV2-expressing cell is provided as a population of lymphocytes. In some embodiments of the methods, the TRDV2-expressing cell is provided as a population of T cells. In some embodiments of the methods, the TRDV2-expressing cell is provided as a sample comprising a population of cells. In some embodiments of the methods, the TRDV2-expressing cell is provided as a sample comprising a population of lymphocytes. In some embodiments of the methods, the TRDV2-expressing cell is provided as a sample comprising a population of T cells. In some embodiments of the methods, the sample is a blood sample. In some embodiments of the methods, the sample is a tissue sample. In some embodiments of the methods, the sample is a tissue culture sample.

In some embodiments of the methods, the TRDV2 antibody is a multispecific TRDV2 antibody provided herein. In some embodiments of the methods, the TRDV2 antibody is a bispecific TRDV2 antibody provided herein. In some embodiments of the methods, the TRDV2 antibody is a trispecific TRDV2 antibody provided herein. In some embodiments of the methods, the TRDV2 antibody is a quadraspecific TRDV2 antibody provided herein. In certain embodiments, the TRDV2 antibody specifically binds to TRDV2. In one embodiment, the multispecific TRDV2 antibody comprises: (a) a first binding domain that binds TRDV2, and (b) a second binding domain that binds to a second target. In one embodiment, the multispecific TRDV2 antibody comprises: (a) a first binding domain that binds TRDV2, and (b) a second binding domain that binds to a second target, and (c) a third binding domain that binds to a third target. In one embodiment, the multispecific TRDV2 antibody comprises: (a) a first binding domain that binds TRDV2, and (b) a second binding domain that binds to a second target, (c) a third binding domain that binds to a third target, and (d) a fourth binding domain that binds to a fourth target. In one embodiment, the multispecific TRDV2 antibody comprises: (a) a first binding domain that specifically binds TRDV2, and (b) a second binding domain that specifically binds to a second target. In one embodiment, the multispecific TRDV2 antibody comprises: (a) a first binding domain that specifically binds TRDV2, and (b) a second binding domain that specifically binds to a second target, and (c) a third binding domain that specifically binds to a third target. In one embodiment, the multispecific TRDV2 antibody comprises: (a) a first binding domain that specifically binds TRDV2, and (b) a second binding domain that specifically binds to a second target, (c) a third binding domain that specifically binds to a third target, and (d) a fourth binding domain that specifically binds to a fourth target.

In specific embodiments of the methods provided herein, the method uses multi-marker detection. In some embodiments, the multi-marker detection uses a multispecific TRDV2 antibody provided herein. In some embodiments, the multi-marker detection uses a bispecific TRDV2 antibody provided herein. In some embodiments, the multi-marker detection uses a trispecific TRDV2 antibody provided herein. In some embodiments, the multi-marker detection uses a quadraspecific TRDV2 antibody provided herein.

In certain embodiments of the methods provided herein, the methods are included as steps in a T cell manufacturing process. In certain embodiments, the cells are CAR-T cells. In certain embodiments of the methods provided herein, the methods are included as steps in a T cell modification process.

In certain embodiments of the methods provided herein, the methods are included as steps in a diagnostic method. In certain embodiments of the methods provided herein, the methods are included as steps in a method to quantify the TRDV2-expressing T cells.

In certain embodiments of the methods provided herein, the method further comprises expanding the enriched, isolated, separated, purified, sorted, selected, captured or detected TRDV2-expressing cells. In certain embodiments, the expanding is in vitro. In certain embodiments, the expanding is in vivo. In certain embodiments of the methods provided herein, the method further comprises growing the enriched, isolated, separated, purified, sorted, selected, captured or detected TRDV2-expressing cells. In certain embodiments, the growing is in vitro. In certain embodiments, the growing is in vivo. In certain embodiments of the methods provided herein, the method further comprises quantifying the enriched, isolated, separated, purified, sorted, selected, captured or detected TRDV2-expressing cells.

In one aspect, the TRGDC antibodies provided herein are used as agents to detect TRGDC-expressing cells. Thus, in other methods, provided is a method of detecting a cell expressing TRGDC, comprising contacting a cell with a TRGDC antibody provided herein. In certain embodiments, the detecting is by ELISA. In some embodiments, the detecting is by FACS analysis. Also provided are kits comprising a TRGDC antibody provided herein, and instructions for use.

Enrichment, isolation, separation, purification, sorting, selecting, capturing or detecting, or any combination thereof can be done using known technologies such as bead, microfluidics, solid support, columns, and the like. For example, TRGDC cells may be separated or visualized using known methods when bound to the TRGDC antibodies provided herein.

The TRGDC antibodies or multispecific TRGDC antibodies provided herein can be used to selectively enrich, isolate, separate, purify, sort, select, capture or detect TRGDC-expressing cells. The TRGDC antibodies or multispecific TRGDC antibodies provided herein may be utilized in a bispecific format, e.g. containing a first antigen binding domain that specifically binds TRGDC and a second antigen binding domain that specifically binds a second target. In other embodiments, the multispecific TRGDC antibodies provided herein may be utilized in a format that further incorporates a third antigen binding domain that specifically binds a third antigen (e.g., at a trispecific antibody). In other embodiments, the multispecific TRGDC antibodies provided herein may be utilized in a format that further incorporates a fourth antigen binding domain that specifically binds a fourth antigen. (e.g., as a quadraspecific antibody).

In one aspect, provided herein is a method of enriching a TRGDC-expressing cell comprising: providing a sample comprising the TRGDC-expressing cell; contacting the sample with a TRGDC antibody provided herein; and enriching the TRGDC-expressing cell bound to the TRGDC antibody. In one aspect, provided herein is a method of isolating a TRGDC-expressing cell comprising: providing a sample comprising the TRGDC-expressing cell; contacting the sample with a TRGDC antibody provided herein; and isolating the TRGDC-expressing cell bound to the TRGDC antibody. In one aspect, provided herein is a method of separating a TRGDC-expressing cell comprising: providing a sample comprising the TRGDC-expressing cell; contacting the sample with a TRGDC antibody provided herein; and separating the TRGDC-expressing cell bound to the TRGDC antibody. In one aspect, provided herein is a method of purifying a TRGDC-expressing cell comprising: providing a sample comprising the TRGDC-expressing cell; contacting the sample with a TRGDC antibody provided herein; and purifying the TRGDC-expressing cell bound to the TRGDC antibody. In one aspect, provided herein is a method of sorting a TRGDC-expressing cell comprising: providing a sample comprising the TRGDC-expressing cell; contacting the sample with a TRGDC antibody provided herein; and sorting the TRGDC-expressing cell bound to the TRGDC antibody. In one aspect, provided herein is a method of selecting a TRGDC-expressing cell comprising: providing a sample comprising the TRGDC-expressing cell; contacting the sample with a TRGDC antibody provided herein; and selecting the TRGDC-expressing cell bound to the TRGDC antibody. In one aspect, provided herein is a method of capturing a TRGDC-expressing cell comprising: providing a sample comprising the TRGDC-expressing cell; contacting the sample with a TRGDC antibody provided herein; and capturing the TRGDC-expressing cell bound to the TRGDC antibody. In one aspect, provided herein is a method of detecting a TRGDC-expressing cell comprising: providing a sample comprising the TRGDC-expressing cell; contacting the sample with a TRGDC antibody provided herein; and detecting the TRGDC-expressing cell bound to the TRGDC antibody.

In one aspect, provided herein is a method of enriching a TRGDC-expressing cell comprising: contacting a TRGDC-expressing cell with a TRGDC antibody provided herein; and enriching the TRGDC-expressing cell bound to the TRGDC antibody. In one aspect, provided herein is a method of isolating a TRGDC-expressing cell comprising: contacting a TRGDC-expressing cell with a TRGDC antibody provided herein; and isolating the TRGDC-expressing cell bound to the TRGDC antibody. In one aspect, provided herein is a method of separating a TRGDC-expressing cell comprising: contacting a TRGDC-expressing cell with a TRGDC antibody provided herein; and separating the TRGDC-expressing cell bound to the TRGDC antibody. In one aspect, provided herein is a method of purifying a TRGDC-expressing cell comprising: contacting a TRGDC-expressing cell with a TRGDC antibody provided herein; and purifying the TRGDC-expressing cell bound to the TRGDC antibody. In one aspect, provided herein is a method of sorting a TRGDC-expressing cell comprising: contacting a TRGDC-expressing cell with a TRGDC antibody provided herein; and sorting the TRGDC-expressing cell bound to the TRGDC antibody. In one aspect, provided herein is a method of selecting a TRGDC-expressing cell comprising: contacting a TRGDC-expressing cell with a TRGDC antibody provided herein; and selecting the TRGDC-expressing cell bound to the TRGDC antibody. In one aspect, provided herein is a method of capturing a TRGDC-expressing cell comprising: contacting a TRGDC-expressing cell with a TRGDC antibody provided herein; and capturing the TRGDC-expressing cell bound to the TRGDC antibody. In one aspect, provided herein is a method of detecting a TRGDC-expressing cell comprising: contacting a TRGDC-expressing cell with a TRGDC antibody provided herein; and detecting the TRGDC-expressing cell bound to the TRGDC antibody.

In one aspect, provided herein is a method of enriching a TRGDC-expressing cell comprising: contacting a TRGDC-expressing cell with a TRGDC antibody provided herein; and enriching the TRGDC-expressing cell based on binding of the TRGDC-expressing cell to the TRGDC antibody. In one aspect, provided herein is a method of isolating a TRGDC-expressing cell comprising: contacting a TRGDC-expressing cell with a TRGDC antibody provided herein; and isolating the TRGDC-expressing cell based on binding of the TRGDC-expressing cell to the TRGDC antibody. In one aspect, provided herein is a method of separating a TRGDC-expressing cell comprising: contacting a TRGDC-expressing cell with a TRGDC antibody provided herein; and separating the TRGDC-expressing cell based on binding of the TRGDC-expressing cell to the TRGDC antibody. In one aspect, provided herein is a method of purifying a TRGDC-expressing cell comprising: contacting a TRGDC-expressing cell with a TRGDC antibody provided herein; and purifying the TRGDC-expressing cell based on binding of the TRGDC-expressing cell to the TRGDC antibody. In one aspect, provided herein is a method of sorting a TRGDC-expressing cell comprising: contacting a TRGDC-expressing cell with a TRGDC antibody provided herein; and sorting the TRGDC-expressing cell based on binding of the TRGDC-expressing cell to the TRGDC antibody. In one aspect, provided herein is a method of selecting a TRGDC-expressing cell comprising: contacting a TRGDC-expressing cell with a TRGDC antibody provided herein; and selecting the TRGDC-expressing cell based on binding of the TRGDC-expressing cell to the TRGDC antibody. In one aspect, provided herein is a method of capturing a TRGDC-expressing cell comprising: contacting a TRGDC-expressing cell with a TRGDC antibody provided herein; and capturing the TRGDC-expressing cell based on binding of the TRGDC-expressing cell to the TRGDC antibody. In one aspect, provided herein is a method of detecting a TRGDC-expressing cell comprising: contacting a TRGDC-expressing cell with a TRGDC antibody provided herein; and detecting the TRGDC-expressing cell based on binding of the TRGDC-expressing cell to the TRGDC antibody.

In certain embodiments of the methods, the TRGDC-expressing cell is a T cell. In some embodiments of the methods, the TRGDC-expressing cell is in a population of cells. In some embodiments of the methods, the TRGDC-expressing cell is in a population of lymphocytes. In some embodiments of the methods, the TRGDC-expressing cell is in a population of T cells. In some embodiments of the methods, the TRGDC-expressing cell is provided as a population of cells. In some embodiments of the methods, the TRGDC-expressing cell is provided as a population of lymphocytes. In some embodiments of the methods, the TRGDC-expressing cell is provided as a population of T cells. In some embodiments of the methods, the TRGDC-expressing cell is provided as a sample comprising a population of cells. In some embodiments of the methods, the TRGDC-expressing cell is provided as a sample comprising a population of lymphocytes. In some embodiments of the methods, the TRGDC-expressing cell is provided as a sample comprising a population of T cells. In some embodiments of the methods, the sample is a blood sample. In some embodiments of the methods, the sample is a tissue sample. In some embodiments of the methods, the sample is a tissue culture sample.

In some embodiments of the methods, the TRGDC antibody is a multispecific TRGDC antibody provided herein. In some embodiments of the methods, the TRGDC antibody is a bispecific TRGDC antibody provided herein. In some embodiments of the methods, the TRGDC antibody is a trispecific TRGDC antibody provided herein. In some embodiments of the methods, the TRGDC antibody is a quadraspecific TRGDC antibody provided herein. In certain embodiments, the TRGDC antibody specifically binds to TRGDC. In one embodiment, the multispecific TRGDC antibody comprises: (a) a first binding domain that binds TRGDC, and (b) a second binding domain that binds to a second target. In one embodiment, the multispecific TRGDC antibody comprises: (a) a first binding domain that binds TRGDC, and (b) a second binding domain that binds to a second target, and (c) a third binding domain that binds to a third target. In one embodiment, the multispecific TRGDC antibody comprises: (a) a first binding domain that binds TRGDC, and (b) a second binding domain that binds to a second target, (c) a third binding domain that binds to a third target, and (d) a fourth binding domain that binds to a fourth target. In one embodiment, the multispecific TRGDC antibody comprises: (a) a first binding domain that specifically binds TRGDC, and (b) a second binding domain that specifically binds to a second target. In one embodiment, the multispecific TRGDC antibody comprises: (a) a first binding domain that specifically binds TRGDC, and (b) a second binding domain that specifically binds to a second target, and (c) a third binding domain that specifically binds to a third target. In one embodiment, the multispecific TRGDC antibody comprises: (a) a first binding domain that specifically binds TRGDC, and (b) a second binding domain that specifically binds to a second target, (c) a third binding domain that specifically binds to a third target, and (d) a fourth binding domain that specifically binds to a fourth target.

In specific embodiments of the methods provided herein, the method uses multi-marker detection. In some embodiments, the multi-marker detection uses a multispecific TRGDC antibody provided herein. In some embodiments, the multi-marker detection uses a bispecific TRGDC antibody provided herein. In some embodiments, the multi-marker detection uses a trispecific TRGDC antibody provided herein. In some embodiments, the multi-marker detection uses a quadraspecific TRGDC antibody provided herein.

In certain embodiments of the methods provided herein, the methods are included as steps in a T cell manufacturing process. In certain embodiments, the cells are CAR-T cells. In certain embodiments of the methods provided herein, the methods are included as steps in a T cell modification process.

In certain embodiments of the methods provided herein, the methods are included as steps in a diagnostic method. In certain embodiments of the methods provided herein, the methods are included as steps in a method to quantify the TRGDC-expressing T cells.

In certain embodiments of the methods provided herein, the method further comprises expanding the enriched, isolated, separated, purified, sorted, selected, captured or detected TRGDC-expressing cells. In certain embodiments, the expanding is in vitro. In certain embodiments, the expanding is in vivo. In certain embodiments of the methods provided herein, the method further comprises growing the enriched, isolated, separated, purified, sorted, selected, captured or detected TRGDC-expressing cells. In certain embodiments, the growing is in vitro. In certain embodiments, the growing is in vivo. In certain embodiments of the methods provided herein, the method further comprises quantifying the enriched, isolated, separated, purified, sorted, selected, captured or detected TRGDC-expressing cells.

EMBODIMENTS

This invention provides the following non-limiting embodiments.

In one set of embodiments, provided are:

A1. An antibody that binds T cell receptor (TCR) Vγ9 (TRGV9), comprising:
 (1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32;
 (2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66;
 (3) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100;
 (4) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134;
 (5) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168;
 (6) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202;

(7) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236;

(8) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270;

(9) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304;

(10) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338;

(11) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372;

(12) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406;

(13) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440;

(14) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474;

(15) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508;

(16) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542;

(17) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576;

(18) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610;

(19) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644;

(20) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678;

(21) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712;

(22) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746;

(23) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780;

(24) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814;

(25) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848;

(26) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882;

(27) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916;

(28) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950;

(29) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984;

(30) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018;

(31) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052;

(32) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086;

(33) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120;

(34) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154;

(35) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188;
(36) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222;
(37) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256;
(38) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290;
(39) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324;
(40) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358;
(41) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392;
(42) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426;
(43) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460;
(44) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494;
(45) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528;
(46) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562;
(47) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596;
(48) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630;
(49) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664;
(50) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698;

(51) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732;

(52) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766;

(53) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800;

(54) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834;

(55) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868;

(56) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902;

(57) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936;

(58) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970; or

(59) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004.

A2. The antibody of embodiment A1, wherein the VH CDR1, VH CDR2, VH CDR3, VL CDR1, VL CDR2, and VL CDR3 amino acid sequences are according to the Kabat numbering system.

A3. The antibody of embodiment A1, wherein the VH CDR1, VH CDR2, VH CDR3, VL CDR1, VL CDR2, and VL CDR3 amino acid sequences are according to the Chothia numbering system.

A4. The antibody of embodiment A1, wherein the VH CDR1, VH CDR2, VH CDR3, VL CDR1, VL CDR2, and VL CDR3 amino acid sequences are according to the AbM numbering system.

A5. The antibody of embodiment A1, wherein the VH CDR1, VH CDR2, VH CDR3, VL CDR1, VL CDR2, and VL CDR3 amino acid sequences are according to the Contact numbering system.

A6. The antibody of embodiment A1, wherein the VH CDR1, VH CDR2, VH CDR3, VL CDR1, VL CDR2, and VL CDR3 amino acid sequences are according to the IMGT numbering system.

A7. The antibody of any one of embodiments A1 to A6, wherein the antibody is a humanized antibody.

A8. The antibody of any one of embodiments A1 to A7, wherein the antibody is an IgG antibody.

A9. The antibody of embodiment A8, wherein the IgG antibody is an IgG1, IgG2, IgG3, or IgG4 antibody.

A10. The antibody of any one of embodiments A1 to A9, wherein the antibody comprises a kappa light chain.

A11. The antibody of any one of embodiments A1 to A9, wherein the antibody comprises a lambda light chain.

A12. The antibody of any one of embodiments A1 to A11, wherein the antibody is a monoclonal antibody.

A13. The antibody of any one of embodiments A1 to A12, wherein the antibody binds a TRGV9 antigen.

A14. The antibody of any one of embodiments A1 to A12, wherein antibody binds a TRGV9 epitope.

A15. The antibody of any one of embodiments A1 to A14, wherein the antibody specifically binds to TRGV9.

A16. The antibody of any one of embodiments A1 to A15, wherein the VH CDR1, VH CDR2, VH CDR3, VL CDR1, VL CDR2 and VL CDR3 form a binding site for an antigen of the TRGV9.

A17. The antibody of any one of embodiments A1 to A15, wherein the VH CDR1, VH CDR2, VH CDR3, VL CDR1, VL CDR2 and VL CDR3 form a binding site for an epitope of the TRGV9.

A18. The antibody of any one of embodiments A1 to A17, wherein the TRGV9 is present on the surface of a T cell.
A19. The antibody of any one of embodiments A1 to A18, wherein the antibody is multivalent.
A20. The antibody of embodiment A19, wherein the antibody is capable of binding at least three antigens.
A21. The antibody of embodiment A19, wherein the antibody is capable of binding at least five antigens.
A22. The antibody of any one of embodiments A1 to A21, wherein the antibody is a multispecific antibody.
A23. The antibody of embodiment A22, wherein the antibody is a bispecific antibody.
A24. A nucleic acid sequence encoding the antibody of any one of embodiments A1 to A23.
A25. A vector comprising the nucleic acid sequence of embodiment A24.
A26. A host cell comprising the vector of embodiment A25.
A27. A kit comprising the vector of embodiment A25 and packaging for the same.
A28. A kit comprising the antibody of any one of embodiments A1 to A23 and packaging for the same.
A29. A pharmaceutical composition comprising the antibody of any one of embodiments A1 to A23, and a pharmaceutically acceptable carrier.
A30. A method of producing the pharmaceutical composition of embodiment A29, comprising combining the antibody with a pharmaceutically acceptable carrier to obtain the pharmaceutical composition.
A31. A method of activating a T cell expressing TRGV9, comprising contacting the T cell with the antibody of any one of embodiments A1 to A23.
A32. The method of embodiment A31, wherein the contacting results in an increase in CD69, CD25, and/or Granzyme B expression, as compared to a control T cell expressing TRGV9.
B1. An antibody that binds TCR Vδ2 (TRDV2), comprising:
 (1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038;
 (2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072;
 (3) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106;
 (4) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140;
 (5) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174;
 (6) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2207; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2208;
 (7) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2241; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2242;
 (8) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2275; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2276;
 (9) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2309; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2310;
 (10) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2343; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2344;
 (11) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2377; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2378;

(12) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2411; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2412;

(13) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2445; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2446;

(14) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2479; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2480;

(15) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2513; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2514;

(16) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2547; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2548;

(17) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2581; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2582;

(18) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2615; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2616;

(19) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2649; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2650;

(20) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2683; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2684;

(21) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2717; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2718;

(22) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2751; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2752;

(23) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2785; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2786;

(24) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2819; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2820;

(25) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2853; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2854;

(26) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2887; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2888;
(27) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2921; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2922;
(28) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2955; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2956;
(29) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2989; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2990;
(30) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3023; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3024;
(31) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3057; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3058;
(32) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3091; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3092;
(33) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3125; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3126;
(34) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3159; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3160;
(35) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3193; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3194;
(36) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3227; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3228;
(37) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3261; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3262;
(38) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3295; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3296;
(39) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3329; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3330;
(40) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3363; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3364;

(41) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3397; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3398;

(42) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3431; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3432;

(43) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3465; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3466;

(44) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3499; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3500;

(45) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3533; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3534;

(46) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3567; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3568;

(47) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3601; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3602;

(48) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3635; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3636;

(49) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3669; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3670;

(50) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3703; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3704;

(51) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3737; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3738;

(52) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3771; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3772;

(53) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3805; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3806;

(54) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3839; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3840;

(55) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3873; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3874;

(56) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3907; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3908;

(57) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3941; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3942;

(58) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3975; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3976;

(59) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4009; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4010;

(60) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4043; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4044;

(61) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4077; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4078; or

(62) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4111; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4112.

B2. The antibody of embodiment B1, wherein the VH CDR1, VH CDR2, VH CDR3, VL CDR1, VL CDR2, and VL CDR3 amino acid sequences are according to the Kabat numbering system.

B3. The antibody of embodiment B1, wherein the VH CDR1, VH CDR2, VH CDR3, VL CDR1, VL CDR2, and VL CDR3 amino acid sequences are according to the Chothia numbering system.

B4. The antibody of embodiment B1, wherein the VH CDR1, VH CDR2, VH CDR3, VL CDR1, VL CDR2, and VL CDR3 amino acid sequences are according to the AbM numbering system.

B5. The antibody of embodiment B1, wherein the VH CDR1, VH CDR2, VH CDR3, VL CDR1, VL CDR2, and VL CDR3 amino acid sequences are according to the Contact numbering system.

B6. The antibody of embodiment B1, wherein the VH CDR1, VH CDR2, VH CDR3, VL CDR1, VL CDR2, and VL CDR3 amino acid sequences are according to the IMGT numbering system.

B7. The antibody of any one of embodiments B1 to B6, wherein the antibody is a humanized antibody.

B8. The antibody of any one of embodiments B1 to B7, wherein the antibody is an IgG antibody.

B9. The antibody of embodiment B8, wherein the IgG antibody is an IgG1, IgG2, IgG3, or IgG4 antibody.

B10. The antibody of any one of embodiments B1 to B9, wherein the antibody comprises a kappa light chain.

B11. The antibody of any one of embodiments B1 to B9, wherein the antibody comprises a lambda light chain.

B12. The antibody of any one of embodiments B1 to B11, wherein the antibody is a monoclonal antibody.

B13. The antibody of any one of embodiments B1 to B12, wherein the antibody binds a TRDV2 antigen.

B14. The antibody of any one of embodiments B1 to B12, wherein antibody binds a TRDV2 epitope.

B15. The antibody of any one of embodiments B1 to B14, wherein the antibody specifically binds to TRDV2.

B16. The antibody of any one of embodiments B1 to B15, wherein the VH CDR1, VH CDR2, VH CDR3, VL CDR1, VL CDR2 and VL CDR3 form a binding site for an antigen of the TRDV2.

B17. The antibody of any one of embodiments B1 to B15, wherein the VH CDR1, VH CDR2, VH CDR3, VL CDR1, VL CDR2 and VL CDR3 form a binding site for an epitope of the TRDV2.

B18. The antibody of any one of embodiments B1 to B17, wherein the TRDV2 is present on the surface of a T cell.

B19. The antibody of any one of embodiments B1 to B18, wherein the antibody is multivalent.

B20. The antibody of embodiment B19, wherein the antibody is capable of binding at least three antigens.

B21. The antibody of embodiment B19, wherein the antibody is capable of binding at least five antigens.

B22. The antibody of any one of embodiments B1 to B21, wherein the antibody is a multispecific antibody.

B23. The antibody of embodiment B22, wherein the antibody is a bispecific antibody.

B24. A nucleic acid sequence encoding the antibody of any one of embodiments B1 to B23.

B25. A vector comprising the nucleic acid sequence of embodiment B24.

B26. A host cell comprising the vector of embodiment B25.

B27. A kit comprising the vector of embodiment B25 and packaging for the same.

B28. A kit comprising the antibody of any one of embodiments B1 to B23 and packaging for the same.

B29. A pharmaceutical composition comprising the antibody of any one of embodiments B1 to B23, and a pharmaceutically acceptable carrier.

B30. A method of producing the pharmaceutical composition of embodiment B29, comprising combining the antibody with a pharmaceutically acceptable carrier to obtain the pharmaceutical composition.

B31. A method of activating a T cell expressing TRDV2, comprising contacting the T cell with the antibody of any one of embodiments B1 to B23.

B32. The method of embodiment B31, wherein the contacting results in an increase in CD69, CD25, and/or Granzyme B expression, as compared to a control T cell expressing TRDV2.

C1. An antibody that binds TCR gamma delta constant region (TRGDC), comprising:
(1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4145; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4146;
(2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4179; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4180;
(3) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4213; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4214;
(4) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4247; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4248;
(5) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4281; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4282;
(6) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4315; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4316;
(7) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4349; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4350;
(8) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4383; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4384;
(9) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4417; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4418;
(10) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4451; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4452;
(11) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4485; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4486;
(12) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4519; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4520;
(13) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4553; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4554;
(14) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4587; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4588;

(15) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4621; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4622; or

(16) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4655; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4656.

C2. The antibody of embodiment C1, wherein the VH CDR1, VH CDR2, VH CDR3, VL CDR1, VL CDR2, and VL CDR3 amino acid sequences are according to the Kabat numbering system.

C3. The antibody of embodiment C1, wherein the VH CDR1, VH CDR2, VH CDR3, VL CDR1, VL CDR2, and VL CDR3 amino acid sequences are according to the Chothia numbering system.

C4. The antibody of embodiment C1, wherein the VH CDR1, VH CDR2, VH CDR3, VL CDR1, VL CDR2, and VL CDR3 amino acid sequences are according to the AbM numbering system.

C5. The antibody of embodiment C1, wherein the VH CDR1, VH CDR2, VH CDR3, VL CDR1, VL CDR2, and VL CDR3 amino acid sequences are according to the Contact numbering system.

C6. The antibody of embodiment C1, wherein the VH CDR1, VH CDR2, VH CDR3, VL CDR1, VL CDR2, and VL CDR3 amino acid sequences are according to the IMGT numbering system.

C7. The antibody of any one of embodiments C1 to C6, wherein the antibody is a humanized antibody.

C8. The antibody of any one of embodiments C1 to C7, wherein the antibody is an IgG antibody.

C9. The antibody of embodiment C8, wherein the IgG antibody is an IgG1, IgG2, IgG3, or IgG4 antibody.

C10. The antibody of any one of embodiments C1 to C9, wherein the antibody comprises a kappa light chain.

C11. The antibody of any one of embodiments C1 to C9, wherein the antibody comprises a lambda light chain.

C12. The antibody of any one of embodiments C1 to C11, wherein the antibody is a monoclonal antibody.

C13. The antibody of any one of embodiments C1 to C12, wherein the antibody binds a TRGDC antigen.

C14. The antibody of any one of embodiments C1 to C12, wherein antibody binds a TRGDC epitope.

C15. The antibody of any one of embodiments C1 to C14, wherein the antibody specifically binds to TRGDC.

C16. The antibody of any one of embodiments C1 to C15, wherein the VH CDR1, VH CDR2, VH CDR3, VL CDR1, VL CDR2 and VL CDR3 form a binding site for an antigen of the TRGDC.

C17. The antibody of any one of embodiments C1 to C15, wherein the VH CDR1, VH CDR2, VH CDR3, VL CDR1, VL CDR2 and VL CDR3 form a binding site for an epitope of the TRGDC.

C18. The antibody of any one of embodiments C1 to C17, wherein the TRGDC is present on the surface of a T cell.

C19. The antibody of any one of embodiments C1 to C18, wherein the antibody is multivalent.

C20. The antibody of embodiment C19, wherein the antibody is capable of binding at least three antigens.

C21. The antibody of embodiment C19, wherein the antibody is capable of binding at least five antigens.

C22. The antibody of any one of embodiments C1 to C21, wherein the antibody is a multispecific antibody.

C23. The antibody of embodiment C22, wherein the antibody is a bispecific antibody.

C24. A nucleic acid sequence encoding the antibody of any one of embodiments C1 to C23.

C25. A vector comprising the nucleic acid sequence of embodiment C24.

C26. A host cell comprising the vector of embodiment C25.

C27. A kit comprising the vector of embodiment C25 and packaging for the same.

C28. A kit comprising the antibody of any one of embodiments C1 to C23 and packaging for the same.

C29. A pharmaceutical composition comprising the antibody of any one of embodiments C1 to C23, and a pharmaceutically acceptable carrier.

C30. A method of producing the pharmaceutical composition of embodiment C29, comprising combining the antibody with a pharmaceutically acceptable carrier to obtain the pharmaceutical composition.

C31. A method of activating a T cell expressing TRGDC, comprising contacting the T cell with the antibody of any one of embodiments C1 to C23.

C32. The method of embodiment C31, wherein the contacting results in an increase in CD69, CD25, and/or Granzyme B expression, as compared to a control T cell expressing TRGDC.

Provided in the Examples herein are exemplary antibodies that bind to TRGV9. Also provided in the Examples herein are exemplary antibodies that bind to TRDV2. Also provided in the Examples herein are exemplary antibodies that bind to TRGDC. Exemplary binding agents that bind to TRGV9 are provided herein, for example in the Examples, as well as Tables 2-7. Exemplary binding agents that bind to TRDV2 are provided herein, for example in the Examples, as well as Tables 2-7. Exemplary binding agents that bind to TRGDC are provided herein, for example in the Examples, as well as Tables 2-7.

Particular embodiments of this invention are described herein. Upon reading the foregoing description, variations of the disclosed embodiments may become apparent to individuals working in the art, and it is expected that those skilled artisans may employ such variations as appropriate. Accordingly, it is intended that the invention be practiced otherwise than as specifically described herein, and that the invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. A number of embodiments of the invention have been described. Nevertheless, it will be understood that various modifications may be made without departing from the spirit and scope of the invention. Accordingly, the descriptions in the Examples section are intended to illustrate but not limit the scope of invention described in the claims.

EXAMPLES

Example 1: Production of Antibodies that Bind γδ T Cells

1.1: Production of Mabs that Bind γδ T Cell Antigens

Antigens or portions of antigens specific for γδ T cells are used to immunize an animal (e.g., a mouse or a rabbit). To generate the γδ T cell monoclonal antibodies, peripheral blood mononuclear cells are isolated from the whole blood of the immunized animal, and antigen specific B cells are grown. B cells secreting reactive antibodies for the γδ T cell antigens are identified by an antigen-binding ELISA screening of the B cell culture supernatants. High binding ELISA plates are coated with the γδ T cell antigen overnight. The ELISA plates are blocked, and diluted B cell culture supernatants are added to the plates. The plates are incubated at room temperature and following incubation, a secondary antibody specific for recognizing the γδ T cell antigen antibody is added to the plate to determine if the γδ T cell antigen antibody bound the γδ T cell antigen. Binding of the antibody is determined by reaction of a substrate on the secondary antibody.

After the identification of monoclonal antibodies that are capable of binding γδ T cell antigens, the variable regions of the heavy and light chains of the γδ T cell antibody are sequenced. γδ T cell antibodies that bind to TRGV9, TRDV2 and TRGDC are produced. Constructs are created for the expression of the heavy and light chain of the γδ T cell antibody. The constructs are transfected into a host cell to express the heavy and light chains, and the γδ T cell antibody is isolated from the supernatant.

1.2: Generation of TRGV9 Antibodies, TRDV2 Antibodies, and TRGDC Antibodies Immunogen. A recombinant human TCR Vγ9×Vδ2 fused to a human Fc was used as an immunogen, and the sequence is listed in Table 1.

Protein Production of the Immunogen. Expression plasmids encoding the immunogen (see Table 1) were transfected into CHO cell at a DNA ratio of 1:1. Total amount of DNA for a 750 mL expression scale was 750 μg. Final expression volume was 1 L after two feedings and enhancer additions. Using an ÄKTAPRIME plus instrument (GE Healthcare Life Sciences), supernatant (1 L) after 7 days was applied with a flow-rate of 5 mL/min to a MAB SELECT SURE (GE Life Sciences) with a column volume (CV) of 10 mL pre-equilibrated with phosphate buffered saline (PBS), pH 6.8. Non-specific proteins binding to the column material was washed off with PBS supplemented with 500 mM NaCl, pH 6.8 (5 CV). The Fc-containing immunogen was eluted stepwise with 40 mM sodium acetate pH 5.0 (5 CV), pH 4.5 (5 CV), pH 4.0 (10 CV), pH 3.5 (5 CV), and pH 3.0 (5 CV). Fractions were pooled, and applied (5 mL) at a flow-rate of 0.2 mL/min on to a HiLoad 16/600 SUPERDEX (GE Healthcare) column pre-equilibrated with PBS (pH 6.8). Target protein was eluted, pooled, and analyzed by SDS-PAGE, analytic SEC, and intact mass by mass spectrometry. Purity was estimated to >99%.

Antibodies were generated using ALIVAMAB transgenic mice technology (Ablexis). ALIVAMAB mice were immunized with recombinant human Vγ9/Vδ2 TCR protein. Lymphocytes were extracted from secondary lymphoid organs and either fused with FO mouse myeloma cell line for hybridoma generation or subjected to single cell sorting via FACS. Hybridoma supernatants were screened by MSD electrochemiluminescence or by FACS for binding to γδ T cells. Confirmed cell binders were light chain isotyped via ELISA. Single cell sorting supernatants were screened by MSD electrochemiluminescence for binding to recombinant human Vγ9/Vδ2 protein. Several hits with the desired binding profile were selected and sequenced, as provided below.

The VH and VL sequences of certain TRGV9, TRDV2, and TRGDC antibodies are provided in Table 2. The CDRs sequences of certain TRGV9, TRDV2, and TRGDC antibodies are provided in Table 3 (Kabat), Table 4 (Chothia), Table 5 (AbM), Table 6 (Contact), and Table 7 (IMGT).

TABLE 1

Amino acid sequence of recombinant human TCR Vγ9 × Vδ2 heterodimeric protein fused to human Fc

| Name | Protein ID | Sequence | SEQ ID NO: |
|---|---|---|---|
| Recombinant human [TCR Vg9 × Vd2]-hFc | Vg9 chain | MAWVWTLLFLMAAAQSIQAAGHLEQPQISSTKTLSKTARLECVV SGITISATSVYWYRERPGEVIQFLVSISYDGTVRKESGIPSGKF EVDRIPETSTSTLTIHNVEKQDIATYYCALWEAQQELGKKIKVF GPGTKLIITDKQLDADVSPKPTIFLPSIAETKLQKAGTYLCLLE KFFPDVIKIHWEEKKSNTILGSQEGNTMKTNDTYMKFSWLTVPE KSLDKEHRCIVRHENNKNGVDQEIIFPPIKTDVITMDPKDNEPK SCDKTHTCPPCPAPELLGGPSVFLFPPKPKDTLMISRTPEVTCV VVDVSHEDPEVKFNWYVDGVEVHNAKTKPREEQYNSTYRVVSVL TVLHQDWLNGKEYKCKVSNKALPAPIEKTISKAKGQPREPQVYV YPPSREEMTKNQVSLTCLVKGFYPSDIAVEWESNGQPENNYKTT PPVLDSDGSFALVSKLTVDKSRWQQGNVFSCSVMHEALHNHYTQ KSLSLSPGK | 4659 |
| | Vd2 chain | MAWVWTLLFLMAAAQSIQAAIELVPEHQTVPVSIGVPATLRCSM KGEAIGNYYINWYRKTQGNTMTFIYREKDIYGPGFKDNFQGDID IAKNLAVLKILAPSERDEGSYYCACDTLGMGGEYTDKLIFGKGT RVTVEPRSQPHTKPSVFVMKNGTNVACLVKEFYPKDIRINLVSS KKITEFDPAIVISPSGKYNAVKLGKYEDSNSVTCSVQHDNKTVH STDFEVKTDSTDHVKPKETENTKQPSKSEPKSCDKTHTCPPCPA PELLGGPSVFLFPPKPKDTLMISRTPEVTCVVVDVSHEDPEVKF NWYVDGVEVHNAKTKPREEQYNSTYRVVSVLTVLHQDWLNGKEY KCKVSNKALPAPIEKTISKAKGQPREPQVYVLPPSREEMTKNQV SLLCLVKGFYPSDIAVEWESNGQPENNYLTWPPVLDSDGSFFLY SKLTVDKSRWQQGNVFSCSVMHEALHNHYTQKSLSLSPGK | 4660 |

TABLE 2

| # | Protein Name | HC Isotype | LC Isotype | VH AA sequence | VL AA sequence | Heavy Chain AA sequence | Light Chain AA sequence |
|---|---|---|---|---|---|---|---|
| 1 | VG9B54 | IgG1 | Kappa | EVQLVESGGGL VKPGGSLRLSC AASGFAFSSYS LTWVRQAPGKG LEWVSSISSSS SYIFYADSVKG RFTISRDNAKN SLYLQMNSLRA EDTAVYYCATD GELGPFDYWGQ GTTVTVSS 31 | EIVMTQSPGT LSLSPGERAT LSCRASQSVS SSYLAWFQQK PGQAPRRLIY GASSRATGIP DRFSGSGSGT DFTLTISRLE PEDFAVYYCQ QYGRSPLTFG GGTKVEIK 32 | EVQLVESGGGLVKPGGSLRLSCAASGFAFSYSLTWVR QAPGKGLEWVSSISSSSYIFYADSVKGRFTISRDNAK NSLYLQMNSLRAEDTAVYYCATDGELGPFDYWGQGTTV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 33 | EIVMTQSPGTLSLSPGERA TLSCRASQSVSSSYLAWFQ QKPGQAPRRLIYGASSRAT GIPDRFSGSGSGTDFTLTI SRLEPEDFAVYYCQQYGRS PLTFGGGTKVEIKRTVAAP SVFIFPPSDEQLKSGTASV VCLLNNFYPREAKVQWKVD NALQSGNSQESVTEQDSKD STYSLSSTLTLSKADYEKH KVYACEVTHQGLSSPVTKS FNRGEC 34 |
| 2 | VG9B121 | IgG1 | Kappa | EVQLVESGGGL VKPGGSLRLSC VASGFTFSDYA MDWVRQAPGKG LDWISSISSTS NYIFYADSVKG RFTISRDNAKN SLYLQMNSLRV EDSAVYYCANS YNWNYGGAFDI WGQGTMVTVSS 65 | DIQMTQSPGT LSSSPGERAT LSCRASQSVS SSYFAWYQQK PGRAPRLLIY GASSRATGIP DRFSGSGSGT DFTLTISRLE PEDFAVYFCQ QYGRSPLTFG GGTKVEIK 66 | EVQLVESGGGLVKPGGSLRLSCVASGFTFSDYAMDWVR QAPGKGLDWISSISSTSNYIFYADSVKGRFTISRDNAK NSLYLQMNSLRVEDSAVYYCANSYNWNYGGAFDIWGQG TMVTVSSASTKGPSVFPLAPSSKSTSGGTAALGCLVKD YFPEPVTVSWNSGALTSGVHTFPAVLQSSGLYSLSSVV TVPSSSLGTQTYICNVNHKPSNTKVDKKVEPKSCDKTH TCPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPGK 67 | DIQMTQSPGTLSSSPGERA TLSCRASQSVSSSYFAWYQ QKPGRAPRLLIYGASSRAT GIPDRFSGSGSGTDFTLTI SRLEPEDFAVYFCQQYGRS PLTFGGGTKVEIKRTVAAP SVFIFPPSDEQLKSGTASV VCLLNNFYPREAKVQWKVD NALQSGNSQESVTEQDSKD STYSLSSTLTLSKADYEKH KVYACEVTHQGLSSPVTKS FNRGEC 68 |
| 3 | VG9B429 | IgG1 | Kappa | QVQLVQSGGGL VKPGGSLRLSC SASGFTFSNYD MNWVRQAPGKG LEWVSSISSSS SYIYADSVKG RFTISRDNAKN SLYLQMNSLRA EDTAVYHCARD VGVTTDYYYG MDVWGQGTMVT VSS 99 | DIQMTQSPSS VSASVGDRVT ITCRASQGIN SWLANYQQKP GNAPKLLIYA ASSLQSGVPS RFSGIGSGTD FIFTISSLQP EDFASYYCQQ ANSFPWTFGQ GTRLEIK 100 | QVQLVQSGGGLVKPGGSLRLSCSASGFTFSNYDMNWVR QAPGKGLEWVSSISSSSYIYADSVKGRFTISRDNAK NSLYLQMNSLRAEDTAVYHCARDVGVTTDYYYGMDVW GQGTMVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 101 | DIQMTQSPSSVSASVGDRV TITCRASQGINSWLANYQQ KPGNAPKLLIYAASSLQSG VPSRFSGIGSGTDFIFTIS SLQPEDFASYYCQQANSFP WTFGQGTRLEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 102 |
| 4 | VG9B370 | IgG1 | Kappa | EVQLVESGGGL VKPGGSLRLSC AASRFTLSSYD MNWVRQAPGKG | EIVLTQSPGT LSLSPGERAT LSCRASQSVS SSYLAWYQQK | EVQLVESGGGLVKPGGSLRLSCAASRFTLSSYDMNWVR QAPGKGLEWVSSISSSSYIYADSVKGRFTISRDNAK NSLYLQMNSLRAEDTAVYYCARDRGVGGTDYYYGLDV WGQGTTVTVSSASTKGPSVFPLAPSSKSTSGGTAALGC | EIVLTQSPGTLSLSPGERA TLSCRASQSVSSSYLAWYQ QKPGQAPRLLIYGASSRAT GIPDRFSGSGSGTDFTLTI |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | LEWVSSISSSS SYIYYADSVKG RFTISRDNAKN SLYLQMNSLRA EDTAVYYCARD RGVGFTDYYY GLDVWGQGTTV TVSS 133 | PGQAPRLLIY GASSRATGIP DRFSGSGSGT DFTLTISRLE PEDFAVYYCQ QYGSSPPYT GGGTKVEIK 134 | LVKDYFPEPVTVSWNSGALTSGVHTFPAVLQSSGLYSL SSVVTVPSSSLGTQTYICNVNHKPSNTKVDKKVEPKSC DKTHTCPPCPAPELLGGPSVFLFPPKPKDTLMISRTPE VTCVVVDVSHEDPEVKFNWYVDGVEVHNAKTKPREEQY NSTYRVVSVLTVLHQDWLNGKEYKCKVSNKALPAPIEK TISKAKGQPREPQVYTLPPSREEMTKNQVSLTCLVKGF YPSDIAVEWESNGQPENNYKTTPPVLDSDGSFFLYSKL TVDKSRWQQGNVFSCSVMHEALHNHYTQKSLSLSPGK 135 | SRLEPEDFAVYYCQQYGSS PPYTFGGQTKVEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 136 |
| 5 | VG9B80 | IgG1 | Kappa | EVQLVQSGGGL VKSGGSLRLSC AASGFTFSTYS MNWVRQAPGKG LEWVSSISSSS SYIFYADSVKG RIIISRDNAKN SLYLQMNSVRA DDTAVYYCAKD GELGVFDYWGQ GTLVTVSS 167 | EIVLTQSPGT LSLSAGERAT LSCRASQSIS SSYLAWYQQK PGQAPRVLIY GPSGRATGIP DRFRGSGSGT DFTLTISRLE PEDFAVYYCQ QFGRSPLTFG GGTKVEIK 168 | EVQLVQSGGGLVKSGGSLRLSCAASGFTFSTYSMNWVR QAPGKGLEWVSSISSSSSYIFYADSVKGRIIISRDNAK NSLYLQMNSVRADDTAVYYCAKDGELGVFDYWGQGTLV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRM QQGNVFSCSVMHEALHNHYTQKSLSLSPGK 169 | EIVLTQSPGTLSLSAGERA TLSCRASQSISSSYLAWYQ QKPGQAPRVLIYGPSGRAT GIPDRFRGSGSGTDFTLTI SRLEPEDFAVYYCQQFGRS PLTFGGGTKVEIKRTVAAP SVFIFPPSDEQLKSGTASV VCLLNNFYPREAKVQWKVD NALQSGNSQESVTEQDSKD STYSLSSTLTLSKADYEKH KVYACEVTHQGLSSPVTKS FNRGEC 170 |
| 6 | VG9B414 | IgG1 | Kappa | EVQLVESGGGL VKPGGSLRLSC SASGFTFSNYD MNWRQAPGKG LEWVSSISSSS SYIYADSVKG RFTISRDNAKN SLYLQMNSLRA EDTAVYHCARD VGVTTDYYYYG MDVWGQGTMVT VSS 201 | EIVMTQSPSS VSASVGDRVT ITCRASQGIN SWLAWYQQKP GNAPKLLIYA ASSLQSGVPS RFSGSGSGTD FIFTISSLQP EDFASTYCQQ ANSFPWTFGQ GTRLEIK 202 | EVQLVESGGGLVKPGGSLRLSCSASGFTFSNYDMNWVR QAPGKGLEWVSSISSSSSYIYYADSVKGRFTISRDNAK NSLYLQMNSLRAEDTAVYHCARDVGVTTDYYYYGMDVW GQGTMTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 203 | EIVMTQSPSSVSASVGDRV TITCRASQGINSWLAWYQQ KPGNAPKLLIYAASSLQSG VPSRFSGIGSGTDFIFTIS SLQPEDFASYYCQQANSFP WTFGQGTRLEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 204 |
| 7 | VG9B195 | IgG1 | Lambda | EVQLVESGGGL VKPGGSLRLSC AASGFTFSPYT MNWVRQAPGKG LEWVSSISSSS SYMYADSVKG RFTISRDNAKN SLYLQMNSLRA EDTAVYYCARD GDLVGPTYYFD | SYELMQPPSV SVSPGQTASI TCSGDKLGDK YACWYQQKPG QSPVLVIYQH NKRPSGIPER FSGSNSGKTA TLTISGTQAM DEADYYCQAW DSTTVVFGGG | EVQLVESGGGLVKPGGSLRLSCAASGFTFSPYTMNWVR QAPGKGLEWVSSISSSSSYMYADSVKGRFTISRDNAKN NSLYLQMNSLRAEDTAVYYCARDGDLVGPTYYFDVWGQ GTLVTVSSASTKGPSVFPLAPSSKSTSGGTAALGCLVK DYFPEPVTVSWNSGALTSGVHTFPAVLQSSGLYSLSSV VTVPSSSLGTQTYICNVNHKPSNTKVDKKVEPKSCDKT HTCPPCPAPELLGGPSVFLFPPKPKDTLMISRTPEVTC VVVDVSHEDPEVKFNWYVDGVEVHNAKTKPREEQYNST YRVVSVLTVLHQDWLNGKEYKCKVSNKALPAPIEKTIS KAKGQPREPQVYTLPPSREEMTKNQVSLTCLVKGFYPS | SYELMQPPSVSVSPGQTAS ITCSGDKLGDKYACWYQQK PGQSPVLVIYQHNKRPSGI PERFSGSNSGKTATLTISG TQAMDEADYYCQAWDSTTV VFGGGTKLTVLQPKAAPS VTLFPPSSEELQANKATLV CLISDFYPGAVTVAWKADS SPVKAGVETTTPSKQSNNK YAASSYLSLTPEQWKSHRS |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| 8 | VG9B140 | IgG1 | Kappa | EVQLVESGGGL VKPGGSLRLSC AGSGFTFRSYD MNWVRQAPGKG LEWVSSISTSS GYIYYADSVKG RFTISRDNAKN SLSLQMNSLRA EDTAVFYCARD RGIAVAGDYYY GMDVWGQGTMV TVSS 269 | EIVMTQSPGT LSLSPGERAT LSCRASQSVS SSYLAWYQQK PGQAPRLLIY GASSRATGIP DRFSGSGSGT DFTLTISRLE AEDFAVYYCQ QYGSSPYTF GQGTKVEIK 270 | EVQLVESGGGLVKPGGSLRLSCAGSGFTFRSYDMNWVR QAPGKGLEWVSSISTSSGYIYYADSVKGRFTISRDNAK NSLSLQMNSLRAEDTAVFYCARDRGIAVAGDYYYGMDV WGQGTMVTVSSASTKGPSVFPLAPSSKSTSGGTAALGC LVKDYFPEPVTVSWNSGALTSGVHTFPAVLQSSGLYSL SSVVTVPSSSLGTQTYICNVNHKPSNTKVDKKVEPKSC DKTHTCPPCPAPELLGGPSVFLFPPKPKDTLMISRTPE VTCVVVDVSHEDPEVKFNWYVDGVEVHNAKTKPREEQY NSTYRVVSVLTVLHQDWLNGKEYKCKVSNKALPAPIEK TISKAKGQPREPQVYTLPPSREEMTKNQVSLTCLVKGF YPSDIAVEWESNGQPENNYKTTPPVLDSDGSFFLYSKL TVDKSRWQQGNVFSCSVMHEALHNHYTQKSLSLSPGK 271 | EIVMTQSPGTLSLSPGERA TLSCRASQSVSSSYLAWYQ QKPGQAPRLLIYGASSRAT GIPDRFSGSGSGTDFTLTI SRLEAEDFAVYYCQQYGSS PPYTFGQGTKVEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 272 |
| 9 | VG9B426 | IgG1 | Kappa | EVQLVQSGGGL VKPGGSLRLSC SASGFTFSNYD MNWVRQAPGKG LEWVSSISSSS SYIYYADSVKG RFTISRDNAKN SLYLQMNSLRA EDTAVYHCARD VGVTTDYYYYG MDVWGQGTMVT VSS 303 | ETTLTQSPGT LSLSPGDRAT LSCRASQSVA SSYLAWYQQK PGQSPRLLIY GASSRATGIP DRFSGSGSGT DFTLTISRLE PEDFAVYYCQ QYGSSPPYTF GQGTKVEIK 304 | EVQLVQSGGGLVKPGGSLRLSCSASGFTFSNYDMNWVR QAPGKGLEWVSSISSSSSYIYYADSVKGRFTISRDNAK NSLYLQMNSLRAEDTAVYHCARDVGVTTDYYYGMDVW GQGTMVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 305 | ETTLTQSPGTLSLSPGDRA TLSCRASQSVASSYLAWYQ QKPGQSPRLLIYGASSRAT GIPDRFSGSGSGTDFTLTI SRLEPEDFAVYYCQQYGSS PPYTFGQGTKVEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 306 |
| 10 | VG9B46 | IgG1 | Kappa | EVQLVESGGGL VKPGGSLRLSC EASGFTFSINS MNWVRQAPGKG LEWVSSISTSS DYIFNADSVKG RFTISRDNAKN SLYLQMNSLRA EDTAVYYCVRD DVFGAFDIWGQ GTMVTVSS 337 | EIVLTQSPGT LSLSPGERAT LSCRTSQSVS RSYLGWYQQK PGQPPRLLIF GSSSRATGIP DRFSGSGSGT DFTLTISRLE PEDFAVYYCQ QYSRSPLTFG GGTKVDIK 338 | EVQLVESGGGLVKPGGSLRLSCEASGFTFSINSMNWVR QAPGKGLEWVSSISTSDYIFNADSVKGRFTISRDNAK NSLYLQMNSLRAEDTAVYYCVRDDVFGAFDIWGQGTMV TVSSASTKGPSVFPLAPSSKSTSGGTAALGCLVKDYFP EPVTVSWNSGALTSGVHTFPAVLQSSGLYSLSSVVTVP SSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 339 | EIVLTQSPGTLSLSPGERA TLSCRTSQSVSRSYLGWYQ QKPGQPPRLLIFGSSSRAT GIPDRFSGSGSGTDFTLTI SRLEPEDFAVYYCQQYSRS PLTFGGGTKVDIKRTVAAP SVFIFPPSDEQLKSGTASV VCLLNNFYPREAKVQWKVD NALQSGNSQESVTEQDSKD STYSLSSTLTLSKADYEKH KVYACEVTHQGLSSPVTKS FNRGEC 340 |
| 11 | VG9B416 | IgG1 | Kappa | EVQLVESGGGL VKPGGSLRLSC | EIVLTQSPGT LSLSPGDRAT | EVQLVESGGGLVKPGGSLRLSCSASGFTFSNYDMNWVR QAPGKGLEWVSSISSSSYIYYADSVKGRFTISRDNAK | EIVLTQSPGTLSLSPGDRA TLSCRASQSVASSYLAWYQ |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | SASGFTFSNYD MNWVRQAPGKG LEWVSSISSSS SYIYADSVKG RFTISRDNAKN SLYLQMNSLRA EDTAVYHCARD VGVTTDYYYG MDVWGQGTTVT VSS | LSCRASQSVA SSYLAWYQQK PGQSPRLLIY GASSRATGIP DRFSGSGSGT DFTLTISRLE PEDFAVYYCQ QYGSSPPYTF GQGTKLEIK | NSLYLQMNSLRAEDTAVYHCARDVGVTTDYYYGMDVW GQGTTVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 373 | QKPGQSPRLLIYGASSRAT GIPDRFSGSGSGTDFTLTI SRLEPEDFAVYYCQQYGSS PPYTFGQGTKLEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 374 |
| 12 | VG9B69 | IgG1 | Kappa | EVQLVESGGGL VKPGGSLRLSC AASGFTFSSYD INWVRQAPGKG LEWVSSITSSS YIIYADSVKG RFTISRDNAKN SLYLQMNSLRA EDTAVYYCARD LGVRGVDYYYY GLDVWGQGTMV TVSS 405 | EIVMTQSPGT LSLSPGERAT LSCRASQSVS SSYLAWYQQK PGQAPRLLIY GASSRATGIP DRFSGSGSGT DFTLTISRLE PEDFAVYYCQ QYGSSPPYTF GQGTKVEIK 406 | EVQLVESGGGLVKPGGSLRLSCAASGFTFSSYDINWVR QAPGKGLEWVSSITSSSYIIYADSVKGRFTISRDNAK NSLYLQMNSLRAEDTAVYYCARDLGVRGVDYYYGLDV WGQGTMVTVSSASTKGPSVFPLAPSSKSTSGGTAALGC LVKDYFPEPVTVSWNSGALTSGVHTFPAVLQSSGLYSL SSVVTVPSSSLGTQTYICNVNHKPSNTKVDKKVEPKSC DKTHTCPPCPAPELLGGPSVFLFPPKPKDTLMISRTPE VTCVVVDVSHEDPEVKFNWYVDGVEVHNAKTKPREEQY NSTYRVVSVLTVLHQDWLNGKEYKCKVSNKALPAPIEK TISKAKGQPREPQVYTLPPSREEMTKNQVSLTCLVKGF YPSDIAVEWESNGQPENNYKTTPPVLDSDGSFFLYSKL TVDKSRWQQGNVFSCSVMHEALHNHYTQKSLSLSPGK 407 | EIVMTQSPGTLSLSPGERA TLSCRASQSVSSSYLAWYQ QKPGQAPRLLIYGASSRAT GIPDRFSGSGSGTDFTLTI SRLEPEDFAVYYCQQYGSS PPYTFGQGTKVEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 408 |
| 13 | VG9B415 | IgG1 | Kappa | EVQLVESGGGL VKPGGSLRLSC SASGFTFSNYD MNWVRQAPGKG LEWVSSISSSS SYIYADSVKG RFTISRDNAKN SLYLQMNSLRA EDTAVYHCARD VGVTTDYYYG MDVWGQGTTVT VSS 439 | ETTLTQSPGT LSLSPGDRAT LSCRASQSVA SSYLAWYQQK PGQSPRLLIY GASSRATGIP DRFSGSGSGT DFTLTISRLE PEDFAVYYCQ QYGSSPPYTF GQGTKLEIK 440 | EVQLVESGGGLVKPGGSLRLSCSASGFTFSNYDMNWVR QAPGKGLEWVSSISSSSSYIYADSVKGRFTISRDNAK NSLYLQMNSLRAEDTAVYHCARDVGVTTDYYYGMDVW GQGTTVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 441 | ETTLTQSPGTLSLSPGDRA TLSCRASQSVASSYLAWYQ QKPGQSPRLLIYGASSRAT GIPDRFSGSGSGTDFTLTI SRLEPEDFAVYYCQQYGSS PPYTFGQGTKLEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 442 |
| 14 | VG9B104 | IgG1 | Kappa | EVQLVESGGGL VKPGGSLRLSC AASGFTFSVYS MNWVRQAPGKG LEWSSIGSSS SYIFYADSVKG RFTISRDNAKN SLYLQMNSLRA | EIVLTQSPGT LSLSPGERAT LSCRASQSVS SSYLAWYQQK PGQAPRLLIY GPSNRATDIP DRFSGTSGST DFTLTISRLE | EVQLVESGGGLVKPGGSLRLSCAASGFTFSVYSMNWVR QAPGKGLEWVSSIGSSSYIFYADSVKGRFTISRDNAK NSLYLQMNSLRAEDTAVYYCGRDHDYGGLDYWGQGTLV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV | EIVLTQSPGTLSLSPGERA TLSCRASQSVSSSYLAWYQ QKPGQAPRLLIYGPSNRAT DIPDRFSGTSGSTDFTLTI SRLEPEDFAVYYCQQYGRS PLTFGGGTKVEIKRTVAAP SVFIFPPSDEQLKSGTASV VCLLNNFYPREAKVQWKVD |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | EDTAVYYCGRD HDYGGLDYWGQ GTLVTVSS 473 | PEDFAVYYCQ QYGRSPLTFG GGTKVEIK 474 | SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 475 | NALQSGNSQESVTEQDSKD STYSLSSTLTLSKADYEKH KVYACEVTHQGLSSPVTKS FNRGEC 476 |
| 15 | VG9B198 | IgG1 | Lambda | QVQLQESGPGL VKPSETLSLTC TVSGDSISSIY WSWIRQPAGKG LEWIGRIYTTD ITNYNPSLKSR VTMSADTSKNQ LSLKLTSVTAA DTAVYYCAKNG YSYGGFNVWGQ GTLVTVSS 507 | QSVLTQPPSV SGAPGQRVTI SCTGSSSNIG AGYDVHWYQ LPGTAPKLLI YGDSTRPSGV PDRFSGSKSG TSASLAITGL QAEDEADYYC QSYDSSLSVV VFGGGTKLTV L 508 | QVQLQESGPGLVKPSETLSLTCTVSGDSISSIYWSWIR QSAGKGLEWIGRIYTTDITNYNPSLKSRVTMSADTSKN QLSLKLTSVTAADTAVYYCAKNGYSYGGFNVWGQGTLV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 509 | QSVLTQPPSVSGAPGQRVT ISCTGSSSNIGAGYDVHWY QRLPGTAPKLLIYGDSYRP SGVPDRFSGSKSGTSASLA ITGLQAEDEADYYCQSYDS SLSVVVFGGGTKLTVLGQP KAAPSVTLFPPSSEELQAN KATLVCLISDFYPGAVTVA WKADSSPVKAGVETTTPSK QSNNKYAASSYLSLTPEQW KSHRSYSCQVTHEGSTVEK TVAPTECS 510 |
| 16 | VG9B463 | IgG1 | Lambda | EVQLVESGGGL VKPGGSLRLSC SASGFTFSNYD MNWRQAPGKG LEWVSSISSSS SYIYYADSVKG RFTISRDNAKN SLYLQMNSLRA EDTAVYHCARD VGVTTDYYYYG MDVWGQGTTVT VSS 541 | QPVLTQSSSA SGTPGQRVTI SCSGSSSNIG SNTVNWYQQF PGTAPKLLIY TNTQRPSGVP DRFSGSKGT LVSLAISGLQ SEDEADYYCA AWDDSLNAWV FGGGTKLTVL 542 | EVQLVESGGGLVKPGGSLRLSCSASGFTFSNYDMNWVR QAPGKGLEWVSSISSSSSYIYYADSVKGRFTISRDNAK NSLYLQMNSLRAEDTAVYHCARDVGVTTDYYYYGMDVW GQGTTVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 543 | QPVLTQSSASGTPGQRVT ISCSGSSSNIGSNTVNMYQ QFPPGTAPKLLIYTNTQRPS GVPDRFSGSKSGTLVSLAI SGLQSEDEADYYCAAWDDS LNAWVFGGGTKLTVLGQPK AAPSVTLFPPSSEELQANK ATLVCLISDFYPGAVTVAW KADSSPVKAGVETTTPSKQ SNNKYAASSYLSLTPEQWK SHRSYSCQVTHEGSTVEKT VAPTECS 544 |
| 17 | VG9B469 | IgG1 | Kappa | EVQLVESGGGL VKPGGSLRLSC AASGFTFSHYD MNWVRQAPGKG LEWVSSISSSS SYIFYADSVKG RFTISRDNAKN SLLLQMNSLRA EDTAVYHCARD RGVGDTSDYYS FGLDVWGQGTM VTVSS 575 | DIVMTQSPGT LSLSPGERAT LSCRASQNVS STYLAMYQQK PGQAPRLLIY GACSRATGIP DRFSGSGSGT DFTLTISRLE PEDYAVYYCQ QYGSSPYTF GRGTKLEIK 576 | EVQLVESGGGLVKPGGSLRLSCAASGFTFSHYDMNWVR QAPGKGLEWVSSISSSSSYIFYADSVKGRFTISRDNAK NSLLLQMNSLRAEDTAVYHCARDRGVGDTSDYYSFGLD VWGQGTMVTVSSASTKGPSVFPLAPSSKSTSGGTAALG CLVKDYFPEPVTVSWNSGALTSGVHTFPAVLQSSGLYS LSSVVTVPSSSLGTQTYICNVNHKPSNTKVDKKVEPKS CDKTHTCPPCPAPELLGGPSVFLFPPKPKDTLMISRTP EVTCVVVDVSHEDPEVKFNWYVDGVEVHNAKTKPREEQ YNSTYRVVSVLTVLHQDWLNGKEYKCKVSNKALPAPIE KTISKAKGQPREPQVYTLPPSREEMTKNQVSLTCLVKG FYPSDIAVEWESNGQPENNYKTTPPVLDSDGSFFLYSK LTVDKSRWQQGNVFSCSVMHEALHNHYTQKSLSLSPGK 577 | DIVMTQSPGTLSLSPGERA TLSCRASQNVSSTYLAWYQ QKPGQAPRLLIYGACSRAT GIPDRFSGSGSGTDFTLTI SRLEPEDYAVYYCQQYGSS PYTFGRGTKLEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 578 |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| 18 | VG9B428 | IgG1 | Kappa | EVQLVESGGGL VKPGGSLRLSC AASGFTFSNYG MNWVRQAPGKG LEWVSYISSGS SYKYADSMKG RFTISRDNAMN LLYLQMNSLRP EDSAMYYCARD PVVTEYYYGM DVWGQGTMVTV SS 609 | EIVMTQSPSS VSASVGDRVT ITCRASQGIN SWLAWYQQKP GNAPKLLIYA ASSLQSGVPS RFSGIGSGTD FIFTISSLQP EDFASYYCQQ ANSFPWTFGQ GTKVEIK 610 | EVQLVESGGGLVKPGGSLRLSCAASGFTFSNYGMNWVR QAPGKGLEWVSYISSGSSYKYADSMKGRFTISRDNAM NLLYLQMNSLRPEDSAMYYCARDPVVTEYYYGMDVWG QGTMVTVSSASTKGPSVFPLAPSSKSTSGGTAALGCLV KDYFPEPVTVSWNSGALTSGVHTFPAVLQSSGLYSLS SVVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 611 | EIVMTQSPSSVSASVGDRV TITCRASQGINSWLAWYQQ KPGNAPKLLIYAASSLQSG VPSRFSGIGSGTDFIFTIS SLQPEDFASYYCQQANSFP WTFGQGTKVEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 612 |
| 19 | VG9B430 | IgG1 | Kappa | EVQLLESGGGL VKPGGSLRLSC SASGFTFSSYD MNWVRQAPGKG LEWVSISSSS SYIYADSVKG RFTISRDNAKN SLYLQMNSLRA EDTAVYHCARD VGVTTDYYYG MDVWGQGTMVT VSS 643 | EIVLTQSPGT LSLSPGDRAT LSCRASQSVA SSYLAWYQQK PGQSPRLLIY GASSRATGIP DRFSGSGSGT DFTLTISRLE PEDFAVYYCQ QYGSSPPYTF GQGTKLEIK 644 | EVQLLESGGGLVKPGGSLRLSCSASGFTFSSYDMNWVR QAPGKGLEWVSISSSSSYIYADSVKGRFTISRDNAK NSLYLQMNSLRAEDTAVYHCARDVGVTTDYYYGMDVW GQGTMVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 645 | EIVLTQSPGTLSLSPGDRA TLSCRASQSVASSYLAWYQ QKPGQSPRLLIYGASSRAT GIPDRFSGSGSGTDFTLTI SRLEPEDFAVYYCQQYGSS PPYTFGQGTKLEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 646 |
| 20 | VG9B423 | IgG1 | Kappa | EVQLVESGGGL VKPGGSLRLSC SASGFTFSNYD MNWVRQAPGKG LEWVSISSSS SYIYADSVKG RFTISRDNAKN SLYLQMNSLRA EDTAVYHCARD VGVTTDYYYG MDVWGQGTMVT VSS 677 | ETTLTQSPGT LSLSPGDRAT LSCRASQSVA SSYLAWYQQK PGQSPRLLIY GASSRATGIP DRFSGSGSGT DFTLTISRLE PEDFAVYYCQ QYGSSPPYTF GQGTKVEIK 678 | EVQLVESGGGLVKPGGSLRLSCSASGFTFSNYDMNWVR QAPGKGLEWVSISSSSSYIYADSVKGRFTISRDNAK NSLYLQMNSLRAEDTAVYHCARDVGVTTDYYYGMDVW GQGTMVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 679 | ETTLTQSPGTLSLSPGDRA TLSCRASQSVASSYLAWYQ QKPGQSPRLLIYGASSRAT GIPDRFSGSGSGTDFTLTI SRLEPEDFAVYYCQQYGSS PPYTFGQGTKVEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 680 |
| 21 | VG9B98 | IgG1 | Kappa | EVQLVQSGGDL VKSGGSLRLSC AASGFTFSSYS MYWVRQAPGKG LEWVSSIGSSS TYIFYADSVKG | EIVLTQSPGT LSLSPGERAT LSCRASQSVS TSYLAWFQQK PGQAPRLLIF GTSSRATGIP | EVQLVQSGGDLVKSGGSLRLSCAASGFTFSSYSMWWVR QAPGKGLEWVSSIGSSSTYIFYADSVKGRFTISRDNAM TSLYLQMNRLGAEDSAVYYCARDGELGPFEYWGQGTLV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP | EIVLTQSPGTLSLSPGERA TLSCRASQSVSTSYLAWFQ QKPGQAPRLLIFGTSSRAT GIPDRFSGSGSGTDFTLTI SRLEPEDFAVYHCLQYGRS PLTFGGGTKVDIKRTVAAP |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | RFTISRDNAMT SLYLQMNRLGA EDSAVYYCARD GELGPFEYWGQ GTLVTVSS | DRFSGSGSGT DFTLTISRLE PEDFAVYHCL QYGRSPLTFG GGTKVDIK | PCPAPELLGGPSVFLFPPKPKDTLMISRTPEVTCVVVD VSHEDPEVKFNWYDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 713 | SVFIFPPSDEQLKSGTASV VCLLNNFYPREAKVQWKVD NALQSGNSQESVTEQDSKD STYSLSSTLTLSKADYEKH KVYACEVTHQGLSSPVTKS FNRGEC 714 |
| 22 | VG9B73 | IgG1 | Kappa | EVQLVQSGGGL VKPGGSLRLSC AASGFTFSNYD MNWVRQAPGKG LEWVSSISSSS SYIYADSVKG RFTISRDNARN SLFLQMSSLRA EDTAVYYCARE IGVTGTTYYQD YGMDVWGQGTT VTVSS 745 | EIVMTQSPGT LSLSPGERAT LSCRASQSFS SNYLAWYQQK PGQAPRLLIY GASSRATGIP DRFSGSGSGT DFTLTISRLE PEDFALYYCQ QYGSSPPTF GGGTKVEIK 746 | EVQLVQSGGGLVKPGGSLRLSCAASGFTFSNYDMNWVR QAPGKGLEWVSSISSSSSYIYADSVKGRFTISRDNAR NSLFLQMSSLRAEDTAVYYCAREIGVTGTTYYQDYGMD VWGQGTTVTVSSASTKGPSVFPLAPSSKSTSGGTAALG CLVKDYFPEPVTVSWNSGALTSGVHTFPAVLQSSGLYS LSSVVTVPSSSLGTQTYICNVNHKPSNTKVDKKVEPKS CDKTHTCPPCPAPELLGGPSVFLFPPKPKDTLMISRTP EVTCVVVDVSHEDPEVKFNWYVDGVEVHNAKTKPREEQ YNSTYRVVSVLTVLHQDWLNGKEYKCKVSNKALPAPIE KTISKAKGQPREPQVYTLPPSREEMTKNQVSLTCLVKG FYPSDIAVEWESNGQPENNYKTTPPVLDSDGSFFLYSK LTVDKSRWQQGNVFSCSVMHEALHNHYTQKSLSLSPGK 747 | EIVMTQSPGTLSLSPGERA TLSCRASQSFSSNYLAWYQ QKPGQAPRLLIYGASSRAT GIPDRFSGSGSGTDFTLTI SRLEPEDFALYYCQQYGSS PPFTFGQGTKVEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 748 |
| 23 | VG9B133 | IgG1 | Kappa | EVQLVESGGGL VKPGGSLRLSC AAAGFTFSNYD MNWVRQVPGKG LEWVSISSSS SYIYADSVKG RFTISRDNAKN SLYLQMNTLRA EDTAVYYCARD LGITGTTMDYY YGMDVWGQGTM VTVSS 779 | EIVMTQSPGT LSLSPGERAT LSCRASQSVS SSYLAWYQQK PGQAPRLLIY GASSRATGIP DRFSGSGSGT DFTLTISRLE PEDFAVYYCQ QYGSSPPYTF GQGTKVDIK 780 | EVQLVESGGGLVKPGGSLRLSCAAAGFTFSNYDMNWVR QVPGKGLEWVSSISSSSSYIYADSVKGRFTISRDNAK NSLYLQMNTLRAEDTAVYYCARDLGITGTTMDYYYGMD VWGQGTMVTVSSASTKGPSVFPLAPSSKSTSGGTAALG CLVKDYFPEPVTVSWNSGALTSGVHTFPAVLQSSGLYS LSSVVTVPSSSLGTQTYICNVNHKPSNTKVDKKVEPKS CDKTHTCPPCPAPELLGGPSVFLFPPKPKDTLMISRTP EVTCVVVDVSHEDPEVKFNWYVDGVEVHNAKTKPREEQ YNSTYRVVSVLTVLHQDWLNGKEYKCKVSNKALPAPIE KTISKAKGQPREPQVYTLPPSREEMTKNQVSLTCLVKG FYPSDIAVEWESNGQPENNYKTTPPVLDSDGSFFLYSK LTVDKSRWQQGNVFSCSVMHEALHNHYTQKSLSLSPGK 781 | EIVMTQSPGTLSLSPGERA TLSCRASQSVSSSYLAWYQ QKPGQAPRLLIYGASSRAT GIPDRFSGSGSGTDFTLTI SRLEPEDFAVYYCQQYGSS PPYTFGQGTKVDIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 782 |
| 24 | VG9B368 | IgG1 | Kappa | EVQLVESGGGL VKPGGSLRLSC AASGFTFNSYD MNWVRQAPGKG LEWVSSISSSS SYIYADSVKG RCTISRDNARN SLYLQMNSLRA EDTAIYYCARD RGIGDYYSYA MDVWGQGTMVT | EIVLTQSPGT LSLSPGERAT LSCRASQSVS SSYLAWYQQK PGQAPRLLIY GASSRATGIP DRFSGSGSGT DFTLTISRLE PEDFAVYYCQ QYGSSPPYTF GQGTKLEIK | EVQLVESGGGLVKPGGSLRLSCAASGFTFNSYDMNWVR QAPGKGLEWVSSISSSSSYIYADSVKGRCTISRDNAR NSLYLQMNSLRAEDTAIYYCARDRGIGDYYSYAMDVW GQGTMVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT | EIVLTQSPGTLSLSPGERA TLSCRASQSVSSSYLAWYQ QKPGQAPRLLIYGASSRAT GIPDRFSGSGSGTDFTLTI SRLEPEDFAVYYCQQYGSS PPYTFGQGTKLEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| 25 | VG9B424 | IgG1 | Kappa | EVQLVESGGGL VKPGGSLRLSC SASGFTFSNYD MNWVRQAPGKG LEWVSSISSSS SYIYADSVKG RFTISRDNAKN SLYLQMNSLRA EDTAVYHCARD VGVTDYYYYG MDVWGQGTMVT VSS 813 | ETTLTQSPGT LSLSPGDRAT LSCRASQSVA SSYLAWYQQK PGQSPRLLIY GASSRATGIP DRFSGSGSGT DFTLTISRLE PEDFAVYYCQ QYGSSPPYTF GQGTKLEIK 814 | EVQLVESGGGLVKPGGSLRLSCSASGFTFSNYDMNWVR QAPGKGLEWVSSISSSSSYIYADSVKGRFTISRDNAK NSLYLQMNSLRAEDTAVYHCARDVGVTTDYYYYGMDVW GQGTMVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 815 | ETTLTQSPGTLSLSPGDRA TLSCRASQSVASSYLAWYQ QKPGQSPRLLIYGASSRAT GIPDRFSGSGSGTDFTLTI SRLEPEDFAVYYCQQYGSS PPYTFGQGTKLEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 816 |
| 26 | VG9B427 | IgG1 | Kappa | QVQLVESGGGL VKPGGSLRLSC SASGFTFSNYD MNWVRQAPGKG LEWVSSISSSS SYIYADSVKG RFTISRDNAKN SLYLQMNSLRA EDTAVYHCARD VGVTDYYYYG MDVWGQGTTVT VSS 847 | EIVMTQSPGT LSLSPGDRAT LSCRASQSVA SSYLAWYQQK PGQSPRLLIY GASSRATGIP DRFSGSGSGT DFTLTISRLE PEDFAVYYCQ QYGSSPPYTF GQGTRLEIK 848 | QVQLVESGGGLVKPGGSLRLSCSASGFTFSNYDMNWVR QAPGKGLEWVSSISSSSSYIYADSVKGRFTISRDNAK NSLYLQMNSLRAEDTAVYHCARDVGVTTDYYYYGMDVW GQGTTVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 849 | EIVMTQSPGTLSLSPGDRA TLSCRASQSVASSYLAWYQ QKPGQSPRLLIYGASSRAT GIPDRFSGSGSGTDFTLTI SRLEPEDFAVYYCQQYGSS PPYTFGQGTRLEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 850 |
| 27 | VG9B417 | IgG1 | Kappa | EVQLVESGGGL VKPGGSLRLSC AASGFTFSNYG MNWVRQAPGKG LEWVSYISSGS SYKYADSMKG RFTISRDNAMN LLYLQMNSLRP EDSAMYYCARD PVVTEYYYGM DVWGQGTTVTV SS 881 | DIVMTQSPSS VSASVGDRVT ITCRASQGIN SWLAWYQQKP GNAPKLLIYA ASSLQSGVPS RPFSGIGSGTD FIFTISSLQP EDFASYYCQQ ANSFPWTFGQ GTKVEIK 882 | EVQLVESGGGLVKPGGSLRLSCAASGFTFSNYGMNWVR QAPGKGLEWVSYISSGSSYKYADSMKGRFTISRDNAM NLLYLQMNSLRPEDSAMYYCARDPVVTEYYYGMDVWG QGTTVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 883 | DIVMTQSPSSVSASVGDRV TITCRASQGINSWLAWYQQ KPGNAPKLLIYAASSLQSG VPSRFSGIGSGTDFIFTIS SLQPEDFASYYCQQANSFP WTFGQGTKVEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 884 |
| 28 | VG9B58 | IgG1 | Kappa | QVQLQESGPGL VKPSETLSLTC TVSGGSIKSSY 915 | DIQMTQSPSA MSASVGDRVT ITCRASQDIT 916 | QVQLQESGPGLVKPSETLSLTCTVSGGSIKSSYWTWIR QPPGKGLEWIGYMFYLGSTNYNPSLKSRVTMSIDTSRN QFSLKLSSVTAADTAVYCSRERPVLDAPDIWGQGTMV 917 | DIQMTQSPSAMSASVGDRV TITCRASQDITNYLAWFQQ KPGKVPKRLIYAASSLQGG 918 |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | WTWIRQPPGKG LEWIGYMFYLG STNYNPSLKSR VTMSIDTSRNQ FSLKLSSVTAA DTAVYYCSRER PVLDAFDIWGQ GTMVTVSS 949 | NYLAWFQQKP GKVPKRLIYA ASSLQGGVPS RFSGSGSGTE FTLTISSLQP EDFSTYYCLQ HDTYPTFGQ GTKVDIK 950 | TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLITCLVKGFYPSDIAV EWESNGQPENNYKTTPPVLDSDGSFFLYSKLTVDKSRW QQGNVFSCSVMHEALHNHYTQKSLSLSPGK 951 | VPSRFSGSGSGTEFTLTIS SLQPEDFSTYYCLQHDTYP YTFGQGTKVDIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 952 |
| 29 | VG9B419 | IgG1 | Kappa | EVQLVESGGGL VKPGGSLRLSC SASGFTFSNYD MNWVRQAPGKG LEWVSSISSSS SYIYYADSVKG RFTISRDNAKN SLYLQMNSLRA EDTAVYHCARD VGVTTDYYYG MDVWGQGTTVT VSS 983 | EIVLTQSPGT LSLSPGDRAT LSCRASQSVA SSYLAWYQQK PGQSPRLLIY GASSRATGIP DRFSGSGSGT DFTLTISRLE PEDFAVYYCQ QYGSSPPYTF GQGTKVEIK 984 | EVQLVESGGGLVKPGGSLRLSCSASGFTFSNYDMNWVR QAPGKGLEWVSSISSSSSYIYYADSVKGRFTISRDNAK NSLYLQMNSLRAEDTAVYHCARDVGVTTDYYYGMDVW GQGTTVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 985 | EIVLTQSPGTLSLSPGDRA TLSCRASQSVASSYLAWYQ QKPGQSPRLLIYGASSRAT GIPDRFSGSGSGTDFTLTI SRLEPEDFAVYYCQQYGSS PPYTFGQGTKVEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 986 |
| 30 | VG9B425 | IgG1 | Kappa | EVQLLESGGGL VKPGGSLRLSC SASGFTFSNYD MNWVRQAPGKG LEWVSSISSSS SYIYYADSVKG RFTISRDNAKN SLYLQMNSLRA EDTAVYHCARD VGVTTDYYYG MDVWGQGTMVT VSS 1017 | ETTLTQSPGT LSLSPGDRAT LSCRASQSVA SSYLAWYQQK PGQSPRLLIY GASSRATGIP DRFSGSGSGT DFTLTISRLE PEDFAVYYCQ QYGSSPPYTF GQGTKVEIK 1018 | EVQLLESGGGLVKPGGSLRLSCSASGFTFSNYDMNWVR QAPGKGLEWVSSISSSSSYIYYADSVKGRFTISRDNAK NSLYLQMNSLRAEDTAVYHCARDVGVTTDYYYGMDVW GQGTMVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 1019 | ETTLTQSPGTLSLSPGDRA TLSCRASQSVASSYLAWYQ QKPGQSPRLLIYGASSRAT GIPDRFSGSGSGTDFTLTI SRLEPEDFAVYYCQQYGSS PPYTFGQGTKVEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 1020 |
| 31 | VG9B143 | IgG1 | Lambda | EVQLVESGGGL VQPGGSLRLSC AASGFTFSTYG MNWVRQAPGKG LEWISYISTSS YTIYYSDSVKG RFTVSRDNAKN SLYLQMNSLRD EDTAVYYCARE | QSALTQPASV SGSPGQSITI SCTGTSSDVG GYNYVSWYQQ HPGKAPKLMI YEVSNRPSGV SYRFSGSKSG NTASLTISGL QAEDEADYYC | EVQLVESGGGLVQPGGSLRLSCAASGFTFSTYGMNWVR QAPGKGLEWISYISTSSYTIYYSDSVKGRFTVSRDNAK NSLYLQMNSLRDEDTAVYYCAREGDMWYFDLMGRGTTV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG | QSALTQPASVSGSPGQSIT ISCTGTSSDVGGYNYVSWY QQHPGKAPKLMIYEVSNRP SGVSYRFSGSKSGNTASLT ISGLQAEDEADYYCSSYTS SSTLVFGGGTKLTVLGQPK AAPSVTLFPPSSEELQANK ATLVCLISDFYPGAVTVAW KADSSPVKAGVETTTPSKQ |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | GDWWFDLWGR GTTVTVSS | SSYTSSSTLV FGGGTKLTVL | QPREPQVYTLPPSREEMTKNQVSLTCLVKGFYPSDIAV EWESNGQPENNYKTTPPVLDSDGSFFLYSKLTVDKSRM QQGNVFSCSVMHEALHNHYTQKSLSLSPGK | SNNKYAASSYLSLTPEQWK SHRSYSCQVTHEGSTVEKT VAPTECS |
| | | | | 1051 | 1052 | 1053 | 1054 |
| 32 | VG9B418 | IgG1 | Kappa | EVQLVQSGGGL VKPGGSLRLSC SASGFTFSNYD MNWVRQAPGKG LEWVSSISSSS SYIYYADSVKG RFTISRDNAKN SLYLQMNSLRA EDTAVYHCARD VGVTTDYYYYG MDVWGQGTMVT VSS | EIVLTQSPGT LSLSPGDRAT LSCRASQSVA SSYLAWYQQK PGQSPRLLIY GASSRATGIP DRFSGSGSGT DFTLTISRLE PEDFAVYYCQ QYGSSPPYTF GQGTKLEIK | EVQLVQSGGGLVKPGGSLRLSCSASGFTFSNYDMNWVR QAPGKGLEWVSSISSSSSYIYYADSVKGRFTISRDNAK NSLYLQMNSLRAEDTAVYHCARDVGVTTDYYYYGMDVW GQGTMVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK | EIVLTQSPGTLSLSPGDRA TLSCRASQSVASSYLAWYQ QKPGQSPRLLIYGASSRAT GIPDRFSGSGSGTDFTLTI SRLEPEDFAVYYCQQYGSS PPYTFGQGTKLEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC |
| | | | | 1085 | 1086 | 1087 | 1088 |
| 33 | VG9B472 | IgG1 | Kappa | QVQLVESGGGL VKPGGSLRLSC AASGFTFSHYD MNWVRQAPGKG LEWVSSISSSS SYIFYADSVKG RFTISRDNAKN SLLLQMNSLRA EDTAVYHCARD RGVGDTSDYYS FGLDWGQGTT VTVSS | EIVLTQSPSS LSASVGDRVT ITCRASQGIA TYLAWYQQKP GKVPNLLIYA ASTLQSGVPS RFSGSGSGTD FTLTISSLQP EDVATYYCQK YNSAPPWTFG QGTKVEIK | QVQLVESGGGLVKPGGSLRLSCAASGFTFSHYDMNWVR QAPGKGLEWVSSISSSSSYIFYADSVKGRFTISRDNAK NSLLLQMNSLRAEDTAVYHCARDRGVGDTSDYYSFGLD VWGQGTTVTVSSASTKGPSVFPLAPSSKSTSGGTAALG CLVKDYFPEPVTVSWNSGALTSGVHTFPAVLQSSGLYS LSSVVTVPSSSLGTQTYICNVNHKPSNTKVDKKVEPKS CDKTHTCPPCPAPELLGGPSVFLFPPKPKDTLMISRTP EVTCVVVDVSHEDPEVKFNWYVDGVEVHNAKTKPREEQ YNSTYRVVSVLTVLHQDWLNGKEYKCKVSNKALPAPIE KTISKAKGQPREPQVYTLPPSREEMTKNQVSLTCLVKG FYPSDIAVEWESNGQPENNYKTTPPVLDSDGSFFLYSK LTVDKSRWQQGNVFSCSVMHEALHNHYTQKSLSLSPGK | EIVLTQSPSSLSASVGDRV TITCRASQGIATYLAWYQQ KPGKVPNLLIYAASTLQSG VPSRFSGSGSGTDFTLTIS SLQPEDVATYYCQKYNSAP PWTFGQGTKVEIKRTVAAP SVFIFPPSDEQLKSGTASV VCLLNNFYPREAKVQWKVD NALQSGNSQESVTEQDSKD STYSLSSTLTLSKADYEKH KVYACEVTHQGLSSPVTKS FNRGEC |
| | | | | 1119 | 1120 | 1121 | 1122 |
| 34 | VG9B421 | IgG1 | Kappa | EVQLVESGGGL VKPGGSLRLSC AASGFTFSNYG MNWVRQAPGKG LEWVSYISSGS SYKYADSMKG RFTISRDNAMN LLYLQMNSLRP EDSAMYYCARD PVVTEYYYGM DVWGQGTMVTV SS | DIQMTQSPSS VSASVGDRVT ITCRASQGIN SWLAWYQQKP GNAPKLLIYA ASSLQSGVPS RFSGIGSGTD FIFTISSLQP EDFASYYCQQ ANSFPWTFGQ GTRLEIK | EVQLVESGGGLVKPGGSLRLSCAASGFTFSNYGMNWVR QAPGKGLEWVSYISSGSSYKYADSMKGRFTISRDNAM NLLYLQMNSLRPEDSAMYYCARDPVVTEYYYYGMDVWG QGTMVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK | DIQMTQSPSSVSASVGDRV TITCRASQGINSWLAWYQQ KPGNAPKLLIYAASSLQSG VPSRFSGIGSGTDFIFTIS SLQPEDFASYYCQQANSFP WTFGQGTRLEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC |
| | | | | 1153 | 1154 | 1155 | 1156 |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| 35 | VG9B88 | IgG1 | Kappa | EVQLVESGGGL VKPGGSLRLSC AVSGFTFSSYT MNWVRQAPGKG LEWVSSISTSS SYIDYADSVKG RFTISRDNAKK SLYLQMNSLRA EDTAVYYCARD GDMVAPIKGSF DYWGQGTLVTV SS 1187 | EIVLTQSPLS LPVTGEPAS ISCRSSQSLL NSDDGNTYLD WYLQKPGQSP QLLIYTLSYR ASGVPDRFSG SGSGTDFTLK ISRVEAEDVG VYYCMQRIEF PITFGQGTRL EIK 1188 | EVQLVESGGGLVKPGGSLRLSCAVSGFTFSSYTMNWVR QAPGKGLEWVSSISTSSSYIDYADSVKGRFTISRDNAK KSLYLQMNSLRAEDTAVYYCARDGDMVAPIKGSFDYWG QGTLVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 1189 | EIVLTQSPLSLPVTGEPA SISCRSSQSLLNSDDGNTY LDWYLQKPGQSPQLLIYTL SYRASGVPDRFSGSGSGTD FTLKISRVEAEDVGVYYCM QRIEFPITFGQGTRLEIKR TVAAPSVFIFPPSDEQLKS GTASVVCLLNNFYPREAKV QWKVDNALQSGNSQESVTE QDSKDSTYSLSSTLTLSKA DYEKHKVYACEVTHQGLSS PVTKSFNRGEC 1190 |
| 36 | VG9B384 | IgG1 | Lambda | QVQLQESGPAL VKPTQTLTLTC TFSGFSLSSSG MCVSWIRQPPG KALEWLTLIDW FDDKKYYSTSLK TRLTISKDTSK NQVVLTMTNMD PVDTATYYCAR IRGTGAYYYGL DVWGQGTMVTV SS 1221 | SYELMQPPSV SVSPGQTASI TCSGNELGDK YASWYQQQPG QSPVLVIYQD NKRPSGIPER FSGSNSGNTA TLTISGTQAM DEADYCQAW DSSKVVFGGG TKLTVL 1222 | QVQLQESGPALVKPTQTLTLTCTFSGFSLSSSGMCVSW IRQPPGKALEWLTLIDWFDDKYYSTSLKTRLTISKDTS KNQVVLTMTNMDPVDTATYYCARIRGTGAYYYGLDVWG QGTMVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 1223 | SYELMQPPSVSVSPGQTAS ITCSGNELGDKYASWYQQQ PGQSPVLVIYQDNKRPSGI PERFSGSNSGNTATLTISG TQAMDEADYYCQAWDSSKV VFGGGTKLTVLQPKAAPS VTLFPPSSEELQANKATLV CLISDFYPGAVTVAWKADS SPVKAGVETTTPSKQSNNK YAASSYLSLTPEQWKSHRS YSCQVTHEGSTVEKTVAPT ECS 1224 |
| 37 | VG9B413 | IgG1 | Kappa | EVQLVESGGGL VKPGGSLRLSC SASGFTFSNYD MNWVRQAPGKG LEWVSISSSSS SYIYADSVKG RFTISRDNAKN SLYLQMNSLRA EDTAVYHCARD VGVTTDYYYG MDVWGQGTMVT VSS 1255 | EIVMTQSPGT LSLSPGDRAT LSCRASQSVA SSYLAWYQQK PGQSPRLLIY GASSRATGIP DRFSGSGSGT DFTLTISRLE PEDFAVYYCQ QYGSSPPYTF GQGTKVEIK 1256 | EVQLVESGGGLVKPGGSLRLSCSASGFTFSNYDMNWVR QAPGKGLEWVSISSSSSYIYADSVKGRFTISRDNAK NSLYLQMNSLRAEDTAVYHCARDVGVTTDYYYGMDVW GQGTMVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 1257 | EIVMTQSPGTLSLSPGDRA TLSCRASQSVASSYLAWYQ QKPGQSPRLLIYGASSRAT GIPDRFSGSGSGTDFLTI SRLEPEDFAVYYCQQYGSS PPYTFGQGTKVEIKRTVAA PSVFIFPPSDEQLKSGTAS VVCLLNNFYPREAKVQNKV DNALQSGNSQESVTEQDSK DSTYSLSSTLTLSKADYEK HKVYACEVTHQGLSSPVTK SFNRGEC 1258 |
| 38 | VG9B36 | IgG1 | Kappa | QVQLVESGGGL VKPGGSLRLSC ASSGFTFSSYG MYWVRQAPGKG LEWVSSISTGS | EIVLTQSPSS LSASVGDRVT ITCQASQDIS NYLNWYQQKP GKAPKLLIYD | QVQLVESGGGLVKPGGSLRLSCASSGFTFSSYGMYWVR QAPGKGLEWVSSISTGSSYIYADSVKGRFTISRDNAK NSLYLQMNSLRAEDTAVYYCARDKGLAVTGYIMDVWGQ GTTVTVSSASTKGPSVFPLAPSSKSTSGGTAALGCLVK DYFPEPVTVSWNSGALTSGVHTFPAVLQSSGLYSLSSV | EIVLTQSPSSLSASVGDRV TITCQASQDISNYLNWYQQ KPGKAPKLLIYDASNLETG VPSRFSGSGSGTDFTFTIS SLQPEDIAIYYCQQYDNLP |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | SYIYYADSVKG RFTISRDNAKN SLYLQMNSLRA EDTAVYYCARD KGLAVTGYIMD VWGQGTTVTVS S 1289 | ASNLETGVPS RFSGSGSGTD FTFTISSLQP EDIAIYYCQQ YDNLPMYTFG QGTKVEIK 1290 | VTVPSSSLGTQTYICNVNHKPSNTKVDKVEPKSCDKT HTCPPCPAPELLGGPSVFLFPPKPKDTLMISRTPEVTC VVVDVSHEDPEVKFNWYVDGVEVHNAKTKPREEQYNST YRVVSVLTVLHQDWLNGKEYKCKVSNKALPAPIEKTIS KAKGQPREPQVYTLPPSREEMTKNQVSLTCLVKGFYPS DIAVEWESNGQPENNYKTTPPVLDSGSFFLYSKLTVD KSRWQQGNVFSCSVMHEALHNHYTQKSLSLSPGK 1291 | MTFGQGTKVEIKRTVAAP SVFIFPPSDEQLKSGTASV VCLLNNFYPREAKVQWKVD NALQSGNSQESVTEQDSKD STYSLSSTLTLSKADYEKH KVYACEVTHQGLSSPVTKS FNRGEC 1292 |
| 39 | VG9B403 | IgG1 | Kappa | EVQLVESGGGL VKPGGSLRLSC SASGFTFSNYD MNWVRQAPGKG LEWVSSISSSS SYIYYADSVKG RFTISRDNAKN SLYLQMNSLRA EDTAVYHCARD VGVTTDYYYYG MDVWGQGTTVT VSS 1323 | DIVMTQSPGT LSLSPGDRAT LSCRASQSVA SSYLAWYQQK PGQSPRLLIY GASSRATGIP DRFSGSGSGT DFTLTISRLE PEDFAVYYCQ QYGSSPPYTF GQGTKVEIK 1324 | EVQLVESGGGLVKPGGSLRLSCSASGFTFSNYDMNWVR QAPGKGLEWVSSISSSSSYIYYADSVKGRFTISRDNAK NSLYLQMNSLRAEDTAVYHCARDVGVTTDYYYYGMDVW GQGTTVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 1325 | DIVMTQSPGTLSLSPGDRA TLSCRASQSVASSYLAWYQ QKPGQSPRLLIYGASSRAT GIPDRFSGSGSGTDFTLTI SRLEPEDFAVYYCQQYGSS PPYTFGQGTKVEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 1326 |
| 40 | VG9B191 | IgG1 | Lambda | EVQLVQSGGGL VKPGGSLRLSC AASGFTFSRYS MNWVRQAPGKG LEGVSSISSSS SYIYYADSVKG RFTISRDNAKN SLYLQMNSLRA EDTAVYYCARD GPTVNWDYYFD LWGRGTLVTVS S 1357 | QSVLTQPPSV SAAPGQKVTI SCSGSSSNIG NNYVWYQQL PGTAPKLLIY DNNKRPSGIP DRFSGSKSGT SATLGITGLQ TGDEADYYCG TWDSSLSTSV VFGGGTKLTV L 1358 | EVQLVQSGGGLVKPGGSLRLSCAASGFTFSRYSMNWVR QAPGKGLEGVSSISSSSSYIYYADSVKGRFTISRDNAK NSLYLQMNSLRAEDTAVYYCARDGPTVNWDYYFDLWGR GTLVTVSSASTKGPSVFPLAPSSKSTSGGTAALGCLVK DYFPEPVTVSWNSGALTSGVHTFPAVLQSSGLYSLSSV VTVPSSSLGTQTYICNVNHKPSNTKVDKKVEPKSCDKT HTCPPCPAPELLGGPSVFLFPPKPKDTLMISRTPEVTC VVVDVSHEDPEVKFNWYVDGVEVHNAKTKPREEQYNST YRVVSVLTVLHQDWLNGKEYKCKVSNKALPAPIEKTIS KAKGQPREPQVYTLPPSREEMTKNQVSLTCLVKGFYPS DIAVEWESNGQPENNYKTTPPVLDSDGSFFLYSKLTVD KSRWQQGNVFSCSVMHEALHNHYTQKSLSLSPGK 1359 | QSVLTQPPSVSAAPGQKVT ISCSGSSSNIGNNYVSWYQ QLPGTAPKLLIYDNNKRPS GIPDRFSGSKSGTSATLGI TGLQTGDEADYYCGTWDSS LSTSVVFGGGTKLTVLGQP KAAPSVTLFPPSSEELQAN KATLVCLISDFYPGAVTVA WKADSSPVKAGVETTPSK QSNNKYAASSYLSLTPEQW KSHRSYSCQVTHEGSTVEK TVAPTECS 1360 |
| 41 | VG9B44 | IgG1 | Kappa | QVQLQQSGPGL VKPSQTLSLTC AISGDSVSSNS AAWNWIRQSPS RGLEWLGRTYY RSKWNDYPIS VKSRISINPDT SKNQFSLQLNS VTPEDTAVYYC ARESGSYYTDG FDIWGQGTMVT | DIQMTQSPSF LSASVGDRVT ITCRASQGIS SYLAWYQQKP GKAPKLLIYA ASTLQSGVPS RFSGSGSGTE FTLTISSLQP EDFATYYCQE FNSYPTFGQ GTKLEIK | QVQLQQSGPGLVKPSQTLSLTCAISGDSVSSNSAAWNW IRQSPSRGLEWLGRTYYRSKWNDYPISVKSRISINPD TSKNQFSLQLNSVTPEDTAVYYCARESGSYYTDGFDIW GQGTMVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT | DIQMTQSPSFLSASVGDRV TITCRASQGISSYLAWYQQ KPGKAPKLLIYAASTLQSG VPSRFSGSGSGTEFTLTIS SLQPEDFATYYCQEFNSYP YTFGQGTKLEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| 42 | VG9B67 | IgG1 | Kappa | EVQLVESGGGL VKPGGSLRLSC AASGFTFSSYT MNWVRQAPGKG LEWVSSISSSS SYIDYAESVKG RFTISRDNAKN SLYLQMNSLRA EDTAVYYCARD GDILATIRGSF DYWGQGTTVTV SS 1391 | DIVMTQTPLS LPVTGEPAS ISCRSSQSLL DSDAGNTYLD WYLQKPGQSP QLLIYTLSYR ASGVPDRFSG SGSGTDFTLK ISRVEAEDVA IYYCMQRIEF PITFGQGTKV EIK 1392 | EVQLVESGGGLVKPGGSLRLSCAASGFTFSSYTMNWVR QAPGKGLEWVSSISSSSSYIDYAESVKGRFTISRDNAK NSLYLQMNSLRAEDTAVYYCARDGDILATIRGSFDYWG QGTTVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 1393 | DIVMTQTPLSLPVTPGEPA SISCRSSQSLLDSDAGNTY LDWYLQKPGQSPQLLIYTL SYRASGVPDRFSGSGSGTD FTLKISRVEAEDVAIYYCM QRIEFPITFGQGTKVEIKR TVAAPSVFIFPPSDEQLKS GTASVVCLLNNFYPREAKV QWKVDNALQSGNSQESVTE QDSKDSTYSLSSTLTLSKA DYEKHKVYACEVTHQGLSS PVTKSFNRGEC 1394 |
| 43 | VG9B402 | IgG1 | Kappa | EVQLVQSGGGL VKPGGSLRLSC AASGFTFSNYG MNWVRQAPGKG LEWVSYISSGS SYKYYADSMKG RFTISRDNAMN LLYLQMNSLRP EDSAMYYCARD PVVTEYYYYGM DVWGQGTMVTV SS 1425 | DIQMTQSPSS VSASVGDRVT ITCRASQGIN SWLAWYQQKP GNAPKLLIYA ASSLQSGVPS RFSGIGSGTD FIFTISSLQP EDFASYYCQQ ANSFPWTFGQ GTKVDIK 1426 | EVQLVQSGGGLVKPGGSLRLSCAASGFTFSNYGMNWVR QAPGKGLEWVSYISSGSSYKYYADSMKGRFTISRDNAM NLLYLQMNSLRPEDSAMYYCARDPVVTEYYYYGMDVWG QGTMVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 1427 | DIQMTQSPSSVSASVGDRV TITCRASQGINSWLAWYQQ KPGNAPKLLIYAASSLQSG VPSRFSGIGSGTDFIFTIS SLQPEDFASYYCQQANSFP WTFGQGTKVDIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 1428 |
| 44 | VG9B127 | IgG1 | Kappa | QVQLVESGGGL VKPGGSLRLSC TASGFTFGAYT MNWVRQAPGKG LEWVSSISSSS SYIDFAESVKG RFTISRDNAKN SLYLQMISLRA EDTAVYYCARD GDIVSTIRGSF DYWGQGALVTV SS 1459 | EIVMTQSPLS LPVTGEPAS ISCRSSQSLL DSDDGNTYLD WYLQKPGQSP QLLIYTLSYR ASGVPDRFSG SGSGTDFTLK ISRVEAEDVG IYYCMQRIEF PITFGQGTKV EIK 1460 | QVQLVESGGGLVKPGGSLRLSCTASGFTFGAYTMNWVR QAPGKGLEWVSSISSSSSYIDFAESVKGRFTISRDNAK NSLYLQMISLRAEDTAVYYCARDGDIVSTIRGSFDYWG QGALVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 1461 | EIVMTQSPLSLPVTPGEPA SISCRSSQSLLDSDDGNTY LDWYLQKPGQSPQLLIYTL SYRASGVPDRFSGSGSGTD FTLKISRVEAEDVGIYYCM QRIEFPITFGQGTKVEIKR TVAAPSVFIFPPSDEQLKS GTASVVCLLNNFYPREAKV QWKVDNALQSGNSQESVTE QDSKDSTYSLSSTLTLSKA DYEKHKVYACEVTHQGLSS PVTKSFNRGEC 1462 |
| 45 | VG9B137 | IgG1 | Kappa | EVQLVESGGGL VKPGGSLRLSC AAFGITFSSYS 1493 | EIVMTQSPGT LSLSPGERAT LSCRASQSVS 1494 | EVQLVESGGGLVKPGGSLRLSCAAFGITFSSYSMDWVR QAPGRGLEWVSIGSSSSYIFYADSVKGRFTISRDNAK NSLYLQMNSLRAEDTAVYYCATSYSWNYGGAFDIWGQG 1495 | EIVMTQSPGTLSLSPGERA TLSCRASQSVSSSYLAWYQ QKPGQAPRLLIYGASSRAT 1496 |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | MDWVRQAPGRG LEWVSIGSSS SYIFYADSVKG RFTISRDNAKN SLYLQMNSLRA EDTAVYYCATS YSWNYGGAFDI WGQGTMVTVSS 1527 | SSYLAWYQQK PGQAPRLLIY GASSRATGIP DRFSGSGSGT DFTLTISRLE PEDFAVYFCQ QYGSSPPYTF GQGTKVEIK 1528 | TMVTVSSASTKGPSVFPLAPSSKSTSGGTAALGCLVKD YFPEPVTVSWNSGALTSGVHTFPAVLQSSGLYSLSSVV TVPSSSLGTQTYICNVNHKPSNTKVDKKVEPKSCDKTH TCPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPGK 1529 | GIPDRFSGSGSGTDFLTLTI SRLEPEDFAVYFCQQYGSS PPYTFGQGTKVEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 1530 |
| 46 | VG9B33 | IgG1 | Kappa | EVQLVESGGGL VKPGGSLRLSC AASGFTFSSYN MNWVRQAPGKG LEWVSSISTSS SYIYYADSVKG RFTISRDNAKN SLYLQMNGLRA EDTAVYYCARD TSVIKYPDTFD IWGQGTMVTVS S 1561 | DIVMTQSPSS LSASVGDRVT ITCRASQDIN NYLAWFQQKP GKVPNLLIYG ASTLQSGVPS RFTGSGSGTD FTLTISSLQP EDVATYYCQK YNSAPTFGP GTKVDIK 1562 | EVQLVESGGGLVKPGGSLRLSCAASGFTFSSYNMNWVR QAPGKGLEWVSSISTSSSYIYYADSVKGRFTISRDNAK NSLYLQMNGLRAEDTAVYYCARDTSVIKYPDTFDIWGQ GTMVTVSSASTKGPSVFPLAPSSKSTSGGTAALGCLVK DYFPEPVTVSWNSGALTSGVHTFPAVLQSSGLYSLSSV VTVPSSSLGTQTYICNVNHKPSNTKVDKKVEPKSCDKT HTCPPCPAPELLGGPSVFLFPPKPKDTLMISRTPEVTC VVVDVSHEDPEVKFNWYVDGVEVHNAKTKPREEQYNST YRVVSVLTVLHQDWLNGKEYKCKVSNKALPAPIEKTIS KAKGQPREPQVYTLPPSREEMTKNQVSLTCLVKGFYPS DIAVEWESNGQPENNYKTTPPVLDSDGSFFLYSKLTVD KSRWQQGNVFSCSVMHEALHNHYTQKSLSLSPGK 1563 | DIVMTQSPSSLSASVGDRV TITCRASQDINNYLAWFQQ KPGKVPNLLIYGASTLQSG VPSRFTGSGSGTDFTLTIS SLQPEDVATYYCQKYNSAP FTFGPGTKVDIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 1564 |
| 47 | VG9B162 | IgG1 | Lambda | QVQLVESGAEV TKPGASVKVSC KASGYTFTGDY MHWVRQAPGQG LEWMGWINPNS GYTNYAQKFQG RVTMTRDTSIS TAYMELSRLRS DDTAVYYCARE GDAPDVWGQGT MVTVSS 1595 | QLVLTQSSSA SGSPGQSVTI SCTGTSSDVG GYNYVSWYQQ HPGKAPKLMI YEVSKRPSGV PDRFSGSKSG NTASLTVSGL QAEDEADYYC NSYAGSNNFE VFGGGTKLTV L 1596 | QVQLVESGAEVTKPGASVKVSCKASGYTFTGDYMHWVR QAPGQGLEWMGWINPNSGYTNYAQKFQGRVTMTRDTSI STAYMELSRLRSDDTAVYYCAREGDAPDVWGQGTMVTV SSASTKGPSVFPLAPSSKSTSGGTAALGCLVKDYFPEP VTVSWNSGALTSGVHTFPAVLQSSGLYSLSSVVTVPSS SLGTQTYICNVNHKPSNTKVDKKVEPKSCDKTHTCPPC PAPELLGGPSVFLFPPKPKDTLMISRTPEVTCVVVDVS HEDPEVKFNWYVDGVEVHNAKTKPREEQYNSTYRVVSV LTVLHQDWLNGKEYKCKVSNKALPAPIEKTISKAKGQP REPQVYTLPPSREEMKNQVSLTCLVKGFYPSDIAVEW ESNGQPENNYKTTPPVLDSDGSFFLYSKLTVDKSRWQQ GNVFSCSVMHEALHNHYTQKSLSLSPGK 1597 | QLVLTQSSASSPGQSVT ISCTGTSSDVGGYNYVSWY QQHPGKAPKLMIYEVSKRP SGVPDRFSGSKSGNTASLT VSGLQAEDEADYYCNSYAG SNNFEVFGGGTKLTVLGQP KAAPSVTLFPPSSEELQAN KATLVCLISDFYPGAVTVA WKADSSPVKAGVETTTPSK QSNNKYAASSYLSLTPEQW KSHRSYSCQVTHEGSTVEK TVAPTECS 1598 |
| 48 | VG9B152 | IgG1 | Lambda | EVQLVESGGGL VRPGGSLRLSC EASGFTFSSYS MIWVRQAPGKG LEWVSISSSS DYINADSVKG RFTISRDNAKN SLYLQMNSLRA EDTAVYYCARD | SYELMQPPSV SVSPGQTASI TCSGDKLGDK YACWYQKPG QSPVLVIYQH NKRPSGIPER FSGSNSGKTA TLTISGTQAM DEADYYCQAW | EVQLVESGGGLVRPGGSLRLSCEASGFTFSSYSMIWVR QAPGKGLEWVSISSSSDYINADSVKGRFTISRDNAK NSLYLQMNSLRAEDTAVYYCARDWELLGFDCMGQGTTV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG | SYELMQPPSVSVSPGQTAS ITCSGDKLGDKYACWYQQK PQSPVLVIYQHNKRPSGI PERFSGSNSGKTATLTISG TQAMDEADYYCQAWDSTV VFGGGTKLTVLGQPKAAPS VTLFPPSSEELQANKATLV CLISDFYPGAVTVAWKADS SPVKAGVETTTPSKQSNNK |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | WELLGFDCWGQ GTTVTVSS 1629 | DSTTVFGGG TKLTVL 1630 | QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 1631 | YAASSYLSLTPBQWKSHRS YSCQVTHEGSTVEKTVAPT ECS 1632 |
| 49 | VG9B64 | IgG1 | Kappa | QVQLVESGPTL VKPTQTLTLTC TFSGFSLSISG VSVGWIRQPPG KALEWLALIYW NDDKRYSPSLQ SRVTITKDTSK NQVLTVTNMD SVDTATYYCVH SGQWLEGDAFD IWGQGTMVTVS S 1663 | DIVMTQTPLS SPVTLGQPAS ISCRSSESLV HSDGNTYLSW LQQSPGQPPR LLIYKISNRF SGVPDRFSGS GAGTDFTLKI SRVEAEDVGV YYCMQATQPP LTFGGGTKLE IK 1664 | QVQLVESGPTLVKPTQTLTLTCTFSGFSLSLSGVSVGW IRQPPGKALEWLALIYWNDDKRYSPSLQSRVTITKDTS KNQVVLTVTNMDSVDTATYYCVHSGQWLEGDAFDIWGQ GTMVTVSSASTKGPSVFPLAPSSKSTSGGTAALGCLVK DYFPEPVTVSWNSGALTSGVHTFPAVLQSSGLYSLSSV VTVPSSSLGTQTYICNVNHKPSNTKVDKKVEPKSCDKT HTCPPCPAPELLGGPSVFLFPPKPKDTLMISRTPEVTC VVVDVSHEDPEVKFNWYVDGVEVHNAKTKPREEQYNST YRVVSVLTVLHQDWLNGKEYKCKVSNKALPAPIEKTIS KAKGQPREPQVYTLPPSREEMTKNQVSLTCLVKGFYPS DIAVEWESNGQPENNYKTTPPVLDSDGSFFLYSKLTVD KSRWQQGNVFSCSVMHEALHNHYTQKSLSLSPGK 1665 | DIVMTQTPLSSPVTLGQPA SISCRSSESLVHSDGNTYL SWLQQSPGQPPRLLIYKIS NRFSGVPDRFSGSGAGTDF TLKISRVEAEDVGVYYCMQ ATQFPLTFGGGTKLEIKRT VAAPSVFIFPPSDEQLKSG TASVVCLLNNFYPREAKVQ WKVDNALQSGNSQESVTEQ DSKDSTYSLSSTLTLSKAD YEKHKVYACEVTHQGLSSP VTKSFNRGEC 1666 |
| 50 | VG9B21 | IgG1 | Kappa | EVQLLESGGGL VKPGGSLRLSC AASGFSFNYD MNWVRQAPRKG LEWVSSISSSS HYIYADSLKG RFTISRDNAKN SLFLQMNSLRA EDTAVYYCARD RGVTTDYYYA LDVWGQGTMVT VSS 1697 | DIVMTQSPSS LSASVGDRVT ITCRASQGIY NYLAWYQQKP GNVPKLLIYA ASTLQSGVPS RFSGSGSGTD FSLTISLQP EDFTTYYCQK YNRAPTFGP GTKVDIK 1698 | EVQLLESGGGLVKPGGSLRLSCAASGFSFNYDMNWVR QAPRKGLEWVSSISSSSHYIYADSLKGRFTISRDNAK NSLFLQMNSLRAEDTAVYYCARDRGVTTDYYYALDVW GQGTMVTVSSASTKGPSVFPLAPSSKSTSGGTAALGCL VKDYFPEPVTVSWNSGALTSGVHTFPAVLQSSGLYSLS SVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 1699 | DIVMTQSPSSLSASVGDRV TITCRASQGIYNYLAWYQQ KPGNVPKLLIYAASTLQSG VPSRFSGSGSGTDFSLTIS SLQPEDFTTYYCQKYNRAP FTFGPGTKVDIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 1700 |
| 51 | VG9B128 | IgG1 | Kappa | EVQLVESGGGV VQPGKSLRLSC TASGFTFGTYG MHWVRQAPGKG LDWVAVIWYNG SNKYYADSVKG RFTISRDNSKN TLYLQMNSLRT EDTAVYYCARG GFGESFDSWGQ GTLVTVSS 1731 | DIVMTQTPAT LSLSPGERAT LSCRASQSVI DYLAWFQQKP GQAPRLLIYD ASNRATGIPA RFSGSGSGTD FTLTISSLEP EDFAVYYCQQ RSNWPLTFGG GTKVEIK 1732 | EVQLVESGGGVVQPGKSLRLSCTASGFTFGTYGMHVR QAPGKGLDWVAVIWYNGSNKYYADSVKGRFTISRDNSK NTLYLQMNSLRTEDTAVYYCARGGFGESFDSWGQGTLV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISRAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 1733 | DIVMTQTPATLSLSPGERA TLSCRASQSVIDYLAWFQQ KPGQAPRLLIYDASNRATG IPARFSGSGSGTDFTLTIS SLEPEDFAVYYCQQRSNWP LTFGGGTKVEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 1734 |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| 52 | VG9B66 | IgG1 | Kappa | EVQLVESGGGL VKPGGSLRLSC AASGFTFSTYT MNWVRQAPGKG LEWVSISSSS FYMDYADSVKG RFTISRDNAKN SLSLLMNSLRA EDTAVYYCARD GDIVATIRGSF DYWGQGTMVTV SS 1765 | EIVLTQSPSS LSTSVGDRVT ITCRASQDIT NFLAWYQQKP GKLPKLLIYT ASTLQSGVPS RFSGSASGPD FTLTISSLQP EDVATYYCQK YNSAPFTGP GTKVEIK 1766 | EVQLVESGGGLVKPGGSLRLSCAASGFTFSTYTMNWVR QAPGKGLEWVSISSSSFYMDYADSVKGRFTISRDNAK NSLSLLMNSLRAEDTAVYYCARDGDIVATIRGSFDYWG QGTMVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 1767 | EIVLTQSPSSLSTSVGDRV TITCRASQDITNFLAWYQQ KPGKLPKLLIYTASTLQSG VPSRFSGSASGPDFTLTIS SLQPEDVATYYCQKYNSAP FTFGPGTKVEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 1768 |
| 53 | VG9B32 | IgG1 | Kappa | EVQLVQSGGDL LQPGGSLRLSC AASGFTFSRYA MNWVRQAPGKG LEWVSFISGTG YTVYYADSVKG RFTISRDNAKN SLYLQMNSLRD EDTAVYYCARD QEPGFDYWGQG TLVTVSS 1799 | DIVMTQTPLS SPVTLQPAS ISCRSGSLV HSDGNTYLSW LQQRPGQPPR LLIYKISNRF SGVPDRFSGS GAGTDFTLKI SRVEAEDVGV YYCMQATHFP FTFGQGTKLE IK 1800 | EVQLVQSGGDLLQPGGSLRLSCAASGFTFSRYAMNWVR QAPGKGLEWVSFISGTGYTVYYADSVKGRFTISRDNAK NSLYLQMNSLRDEDTAVYYCARDQEPGFDYWGQGTLVT VSSASTKGPSVFPLAPSSKSTSGGTAALGCLVKDYFPE PVTVSWNSGALTSGVHTFPAVLQSSGLYSLSSVVTVPS SSLGTQTYICNVNHKPSNTKVDKKVEPKSCDKTHTCPP CPAPELLGGPSVFLFPPKPKDTLMISRTPEVTCVVVDV SHEDPEVKFNWYVDGVEVHNAKTKPREEQYNSTYRVVS VLTVLHQDWLNGKEYKCKVSNKALPAPIEKTISKAKGQ PREPQVYTLPPSREEMTKNQVSLTCLVKGFYPSDIAVE WESNGQPENNYKTTPPVLDSDGSFFLYSKLTVDKSRWQ QGNVFSCSVMHEALHNHYTQKSLSLSPGK 1801 | DIVMTQTPLSSPVTLQPA SISCRSGQSLVHSDGNTYL SWLQQRPGQPPRLLIYKIS NRFSGVPDRFSGSGAGTDF TLKISRVEAEDVGVYYCMQ ATHFPFTFGQGTKLEIKRT VAAPSVFIFPPSDEQLKSG TASVVCLLNNFYPREAKVQ WKVDNALQSGNSQESVTEQ DSKDSTYSLSSTLTLSKAD YEKHKVYACEVTHQGLSSP VTKSFNRGEC 1802 |
| 54 | VG9B57 | IgG1 | Kappa | EVQLVESGGGL VKPGGSLRLSC AASGFTFSSHD MNWVRQAPGKG LGWVSISSSS SYIFYADSVKG RFTISRDNAKN SLYLQMSSLRA EDTAVYYCARD LGVGVRDYYYY GMDVWGQGTMV TVSS 1833 | DIQMTQSPSA MSASVGDRVT ITCRASQDIT NYLAWFQQKP GKVPKRLIYA ASSLQGGVPS RFSGSGSGTE FTLTISSLQP EDFSTYYCLQ HDTYPYTFGQ GTKLEIK 1834 | EVQLVESGGGLVKPGGSLRLSCAASGFTFSSHDMNWVR QAPGKGLGWVSISSSSSYIFYADSVKGRFTISRDNAK NSLYLQMSSLRAEDTAVYYCARDLGVGVRDYYYYGMDV WGQGTMVTVSSASTKGPSVFPLAPSSKSTSGGTAALGC LVKDYFPEPVTVSWNSGALTSGVHTFPAVLQSSGLYSL SSVVTVPSSSLGTQTYICNVNHKPSNTKVDKKVEPKSC DKTHTCPPCPAPELLGGPSVFLFPPKPKDTLMISRTPE VTCVVVDVSHEDPEVKFNWYVDGVEVHNAKTKPREEQY NSTYRVVSVLTVLHQDWLNGKEYKCKVSNKALPAPIEK TISKAKGQPREPQVYTLPPSREEMTKNQVSLTCLVKGF YPSDIAVEWESNGQPENNYKTTPPVLDSDGSFFLYSKL TVDKSRWQQGNVFSCSVMHEALHNHYTQKSLSLSPGK 1835 | DIQMTQSPSAMSASVGDRV TITCRASQDITNYLAWFQQ KPGKVPKRLIYAASSLQGG VPSRFSGSGSGTEFTLTIS SLQPEDFSTYYCLQHDTYP YTFGQGTKLEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 1836 |
| 55 | VG9B135 | IgG1 | Kappa | QVTLKESGPTL VTPSQTLLTC TFSGFSLTTYG VGVGWIRQPPG KALEWLALIYW | DIVMTQSPGT LSLSPGERAT LSCRASQSVS SSYLAWYQQK PGQAPRLLIY | QVTLKESGPTLVTPSQTLTLCTFSGFSLTTYGVGVGW IRQPPGKALEWLALIYWNDDKRYYPSLNNRLTITKDTS KHLVVLTLTNMDPVDTATYYCAHDYDFWSGYFDYWGQG TLVTVSSASTKGPSVFPLAPSSKSTSGGTAALGCLVKD YFPEPVTVSWNSGALTSGVHTFPAVLQSSGLYSLSSW | DIVMTQSPGTLSLSPGERA TLSCRASQSVSSSYLAWYQ QKPGQAPRLLIYGASSRAT GIPDRFSGSGSGTDFTLTI SRLEPEDFAVYYCQQYGSS |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | NDDKRYYPSLN NRLTITKDTSK HLVVLTLTNMD PVDTATYYCAH DYDFWSGYFDY WGQGTLVTVSS | GASSRATGIP DRFSGSGSGT DFTLITSRLE PEDFAVYYCQ QYGSSPLTFG GGTKVEIK | TVPSSLGTQTYICNVNHKPSNTKVDKKVEPKSCDKTH TCPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPGK 1869 | PLTFGGGTKVEIKRTVAAP SVFIFPPSDEQLKSGTASV VCLLNNFYPREAKVQWKVD NALQSGNSQESVTEQDSKD STYSLSSTLTLSKADYEKH KVYACEVTHQGLSSPVTKS FNRGEC 1870 |
| 56 | VG9B60 | IgG1 | Kappa | QVQLVQSGAEV KKPGASVKVSC KASGYTFTGYY MHWVRQAPGQG LEWMGRINPNS GVTHYAQKFQG RVTMTRDTSIS TAYMELSRLRS DDTAVYYCARG GSLVRGVISGL DYWGQGTTVTV SS 1901 | DIVMTQSPGT LSLSPGERAT LSCRASQSFS GSYLAWYQQK PGQAPSLLIY GASSRATGIP DRFSGSGSGT DFTLITSRLE PEDFALYYCQ QYGSSPPYTF GQGTKVEIK 1902 | QVQLVQSGAEVKKPGASVKVSCKASGYTFTGYYMHWVR QAPGQGLEWMGRINPNSGVTHYAQKFQGRVTMTRDTSI STAYMELSRLRSDDTAVYYCARGGSLVRGVISGLDYWG QGTTVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 1903 | DIVMTQSPGTLSLSPGERA TLSCRASQSFSGSYLAWYQ QKPGQAPSLLIYGASSRAT GIPDRFSGSGSGTDFTLTI SRLEPEDFALYYCQQYGSS PPYTFGQGTKVEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 1904 |
| 57 | VG9B409 | IgG1 | Kappa | EVQLVESGAEV KKPGASVKVSC KASGYTLTSYY MHWVRQAPGQG LEWMGIINPSG GSTSYAQKFQG RVTMTRDTSTS TVYMELSSLRS EDTAVYYCARG SYGWYFDLWGR GTLVTVSS 1935 | EIVLTQSPGT LSLSPGERAT LSCRASQSVT SSYLAWYQQK PGQTPRLLIY GASSRATGIP DRISGSGSGT DFTLTVSRLE PEDFAVYYCQ QYGSSPPYTF GQGTKLEIK 1936 | EVQLVESGAEVKKPGASVKVSCKASGYTLTSYYMHWVR QAPGQGLEWMGIINPSGGSTSYAQKFQGRVTMTRDTST STVYMELSSLRSEDTAVYYCARGSYGWYFDLWGRGTLV TVSSASTKGPSVFPLAPSSKSTSGGTAALGCLVKDYFP EPVTVSWNSGALTSGVHTFPAVLQSSGLYSLSSVVTVP SSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 1937 | EIVLTQSPGTLSLSPGERA TLSCRASQSVTSSYLAWYQ QKPGQTPRLLIYGASSRAT GIPDRISGSGSGTDFTLTV SRLEPEDFAVYYCQQYGSS PPYTFGQGTKLEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 1938 |
| 58 | VG9B411 | IgG1 | Kappa | EVQLVESGGGL VKPGGSLRLSC SASGFTFSNYD MNWVRQAPGKG LEWVSSISSSS SYIYYADSVKG RFTISRDNAKN SLYLQMNSLRA EDTAVYHCARD VGVTTDYYYG MDVWGQGTTVT 1935 | EIVMTQSPSS VSASVGDRVT ITCRASQGIN SWLAWYQQDP YKAPKLLIYA ASTLQSGVPS RFGGRGSGTE FTLTISSLQP EDFAVYYCQQ YNNWPRTFGQ GTKVDIK 1936 | EVQLVESGGGLVKPGGSLRLSCSASGFTFSNYDMNWVR QAPGKGLEWVSSISSSSSYIYYADSVKGRFTISRDNAK NSLYLQMNSLRAEDTAVYHCARDVGVTTDYYYGMDVW GQGTTVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTPPVLDSDGSFFLYSKLT 1937 | EIVMTQSPSSVSASVGDRV TITCRASQGINSWLAWYQQ DPYKAPKLLIYAASTLQSG VPSRFGGRGSGTEFTLTIS SLQPEDFAVYYCQQYNNWP RTFGQGTKVDIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF 1938 |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| 59 | VG9B129 | IgG1 | Kappa | EVQLVQSGAEV KKPGSSVKVSC KASGGTFSSYY ISWVRQAPGQG LEWMGGILPIL STANYAQKFQG RVTITADKSTS TAYMELSSLRS EDTAVYYCARA HDYYYGMDVWG QGTTVTVSS 1969 | EIVLTQSPGT LSLSPGERAT LSCRASQSVS NNYLAWYQQK PGQAPRLLIY GASSRATGIP DRFSGSGSGT DFTLTISRLE PEDFAVYYCQ QYGSSPPYTF GQGTKVDIK 1970 | VDKSRWQQGNVFSCSVMHEALHNHYTQKSLSLSPGK 1971 | EVQLVQSGAEVKKPGSSVKVSCKASGGTFSSYYISWVR QAPGQGLEWMGGILPILSTANYAQKFQGRVTITADKST STAYMELSSLRSEDTAVYYCARAHDYYYGMDVWGQGTT VTVSSASTKGPSVFPLAPSSKSTSGGTAALGCLVKDYF PEPVTVSWNSGALTSGVHTFPAVLQSSGLYSLSSVVTV PSSSLGTQTYICNVNHKPSNTKVDKKVEPKSCDKTHTC PPCPAPELLGGPSVFLFPPKPKDTLMISRTPEVTCVVV DVSHEDPEVKFNWYVDGVEVHNAKTKPREEQYNSTYRV VSVLTVLHQDWLNGKEYKCKVSNKALPAPIEKTISKAK GQPREPQVYTLPPSREEMTKNQVSLTCLVKGFYPSDIA VEWESNGQPENNYKTTPPVLDSDGSFFLYSKLTVDKSR WQQGNVFSCSVMHEALHNHYTQKSLSLSPGK 1972 | EIVLTQSPGTLSLSPGERA TLSCRASQSVSNNYLAWYQ QKPGQAPRLLIYGASSRAT GIPDRFSGSGSGTDFTLTI SRLEPEDFAVYYCQQYGSS PPYTFGQGTKVDIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC |
| 60 | VG9B396 | IgG1 | Lambda | EVQLVESGPGL VQPSETLSLTC TVSGDSIRGYY WNWIRQPAGKG LEWIGRIFFTG NTNYNPSLKSR LTMSLDTSKNQ FSLKLNSVTAA DTAVYYCAREK WDSSSALYPD FWGQGTLVTVS S 2037 | QSVLTQAPSV SGAPGQRVTI SCTGSSSNIG ADYDVKWYQQ LPGTAPKLLI YGNTDRPSGV PDRFSGSKSG TSASLAITGL QAEDEADYYC QSYDSRLTGY VVFGGGTKLT VL 2038 | EVQLVESGPGLVQPSETLSLTCTVSGDSIRGYYWNWIR QPAGKGLEWIGRIFFTGNTNYNPSLKSRLTMSLDTSKN QFSLKLNSVTAADTAVYYCAREKWDSSSALYPDFWGQ GTLVTVSSASTKGPSVFPLAPSSKSTSGGTAALGCLVK DYFPEPVTVSWNSGALTSGVHTFPAVLQSSGLYSLSSV VTVPSSSLGTQTYICNVNHKPSNTKVDKKVEPKSCDKT HTCPPCPAPELLGGPSVFLFPPKPKDTLMISRTPEVTC VVVDVSHEDPEVKFNWYVDGVEVHNAKTKPREEQYNST YRVVSVLTVLHQDWLNGKEYKCKVSNKALPAPIEKTIS KAKGQPREPQVYTLPPSREEMTKNQVSLTCLVKGFYPS DIAVEWESNGQPENNYKTTPPVLDSDGSFFLYSKLTVD KSRWQQGNVFSCSVMHEALHNHYTQKSLSLSPGK 2039 | QSVLTQAPSVSGAPGQRVT ISCTGSSSNIGADYDVKWY QQLPGTAPKLLIYGNTDRP SGVPDRFSGSKSGTSASLA ITGLQAEDEADYYCQSYDS RLTGYVVFGGGTKLTVLGQ PKAAPSVTLFPPSSEELQA NKATLVCLISDFYPGAVTV AWKADSSPVKAGVETTTPS KQSNNKYAASSYLSLTPEQ WKSHRSYSCQVTHEGSTVE KTVAPTECS 2040 |
| 61 | VG9B470 | IgG1 | Kappa | QVTLKESGPTL VKPTQTLTLTC TFSGFSLTTSG VGVGWIRQPPG KALEWLALIIW NDHTIYSPSLK SRLIITKDTSK NQVVLTMTNMD PVDTAAYFCAR DKWELRDAFDI WGQGTMVTVSS 2071 | EIVMTQSPSF LSASVGDRVT FTCRASQGIS RYLAWYQQKP GRAPNLLIYV ASTLQSGVPS RFSGSGSGTE FTLTISSLLP EDFATYYCQQ LISYPYTFSQ GTRLEIK 2072 | QVTLKESGPTLVKPTQTLTLTCTFSGFSLTTSGVGVGW IRQPPGKALEWLALIIWNDHTIYSPSLKSRLIITKDTS KNQVVLTMTNMDPVDTAAYFCARDKWELRDAFDIWGQG TMVTVSSASTKGPSVFPLAPSSKSTSGGTAALGCLVKD YFPEPVTVSWNSGALTSGVHTFPAVLQSSGLYSLSSVV TVPSSSLGTQTYICNVNHKPSNTKVDKKVEPKSCDKTH TCPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPGK 2073 | EIVMTQSPSFLSASVGDRV TFTCRASQGISRYLAWYQQ KPGRAPNLLIYVASTLQSG VPSRFSGSGSGTEFTLTIS SLLPEDFATYYCQQLISYP YTFSQGTRLEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 2074 |
| 62 | VG9B111 | IgG1 | Kappa | QVQLLESGGGL VKPGGSLRLSC AASGFTFSTYS 2071 | DIVMTQSPSS LSASVGDRVT ITCQASQDIS 2072 | QVQLLESGGGLVKPGGSLRLSCAASGFTFSTYSVNWVR QAPGKGLEWVSSISDSSYIFYADSMKGRFTISRDNAK NSLYLHMNSLRAEDTAVYYCARDSVTGPFDYWGQGTLV | DIVMTQSPSSLSASVGDRV TITCQASQDISHYLNWYQQ KPGKAPKLLIYDSYILETG |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| 63 | VG9B169 | IgG1 | Lambda | EVQLLESGPGL VKPSETLSLTC SVSGGSITNYF WNWIRQPPGKG LEWIGYIFYSG STSYNPSLKSR VTISVDTSKNR FSLKLISVTAA DTAVYYCARVG RWELRTAFDIW GQGTMVTVSS 2139 | QSALTQPPSA SGTPGQRVTI SCSGSSNIG SNTVNWYQQL PGTAPKLLIY SNNQRPSGVP DRFSGSKSGT SASLAISGLQ SEDEADYYCA AWDDSLNGPG VFGGGTKLTV L 2140 | EVQLLESGPGLVKPSETLSLTCSVSGGSITNYFWNWIR QPPGKGLEWIGYIFYSGSTSYNPSLKSRVTISVDTSKN RFSLKLISVTAADTAVYYCARVGRWELRTAPDIWGQGT MVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK 2141 | QSALTQPPSASGTPGQRVT ISCSGSSNIGSNTVNWYQ QLPGTAPKLLIYSNNQRPS GVPDRFSGSKSGTSASLAI SGLQSEDEADYCAAWDDS LNGPGVFGGGTKLTVLGQP KAAPSVTLFPPSSEELQAN KATLVCLISDFYPGAVTVA WKADSSPVKAGVETTPSK QSNNKIAASSYLSLTPEQW KSHRSYSCQVTHEGSTVEK TVAPTECS 2142 |
| 64 | VG9B639 | IgG1 | Kappa | QVQLVQSGGGL VKPGGSLRLSC AASGFTFTTYR MNWVRQAPGKG LEWVSSISSSS IYIHSADSVKG RFTISRDNAKN SLYLQMNSLRA EDSAIYYCARE RVYTVSFDYWG QGTLVTVSS 2173 | DIQMTQSPSS LSASVGDRVT ITCQASQDIS HYLNWYQQKP GKAPKLLIYD SYILETGVTS RFSGSGSGTD FTFTINSLQP EDIAIYYCQQ YDNLPYTFGQ GTKVEIK 2174 | QVQLVQSGGGLVKPGGSLRLSCAASGFTFTTYRMNWVR QAPGKGLEWVSSISSSSIYIHSADSVKGRFTISRDNAK NSLYLQMNSLRAEDSAIYYCARERVYTVSFDYWGQGTL VTVSSASTKGPSVFPLAPSSKSTSGGTAALGCLVKDYF PEPVTVSWNSGALTSGVHTFPAVLQSSGLYSLSSVVTV PSSSLGTQTYICNVNHKPSNTKVDKKVEPKSCDKTHTC PPCPAPELLGGPSVFLFPPKPKDTLMISRTPEVTCVVV DVSHEDPEVKFNWYVDGVEVHNAKTKPREEQYNSTYRV VSVLTVLHQDWLNGKEYKCKVSNKALPAPIEKTISKAK GQPREPQVYTLPPSREEMTKNQVSLTCLVKGFYPSDIA VEWESNGQPENNYKTTPPVLDSDGSFFLYSKLTVDKSR WQQGNVFSCSVMHEALHNHYTQKSLSLSPGK 2175 | DIQMTQSPSSLSASVGDRV TITCQASQDISHYLNWYQQ KPGKAPKLLIYDSYILETG VTSRFSGSGSGTDFTFTIN SLQPEDIAIYYCQQYDNLP YTFGQGTKVEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 2176 |
| 65 | VG9B201 | IgG1 | Lambda | QVTLKESGPTL VKPTQTLTLTC TFSGFSLTTHG VGVGWIRQPPR KALEWLALIYW NADKHYSPSLK SRLTITKDTSK NQVLTMTHMD PVDTATYYCAH 2173 | QLVLTQPPSV SAAPGQKVTI SCSGSSSNIG NNDSWYQQL PGTAPKLLIY DNNRRPSGIP DRFSGSKSGT SATLGITGLQ TGDEADYCE 2174 | QVTLKESGPTLVKPTQTLTLTCTFSGFSLTTHGVGVGW IRQPPRKALEWLALIYWNADKHYSPSLKSRLTITKDTS KNQVVLTMTHMDPVDTATYYCAHEGDMGHYPDFWQGGT LVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA 2175 | QLVLTQPPSVSAAPGQKVT ISCSGSSSNIGNNDVSWYQ QLPGTAPKLLIYDNNRRPS GIPDRFSGSKSGTSATLGI TGLQTGDEADYCETWDSS LSAIWFGGGTKVTVLGQP KAAPSVLCLISDFYPGAVTVA WKADSSPVKAGVETTPSK 2176 |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | EGDWGHYFDFW GQGTLVTVSS | TWDSSLSAIW VFGGGTKVTV L | KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK 2209 | QSNNKYAASSYLSLTPEQW KSHRSYSCQVTHEGSTVEK TVAPTECS 2210 |
| 66 | VG9B161 | IgG1 | Lambda | QVQLQESGPGL VKPSETLSLTC TVSGGSISSYF WSWIRQPPGKG LEWIGYIFYSG STNYNPSLKSR VTILVDTSKNH FSLKLSSVTAA DTAVYCARVG RWELRGAFDIW GQGTMVTVSS 2241 | QPVLTQSSSA SGTPGQRVTI SCSGSSSNIG SNTVNWYQQF PGTAPKLLIY SNNQRPSGVP DRFSGSKSGT SASLAISGLQ SEDEAEYYCA AWDDSLNSPG VFGGGTKLTV L 2242 | QVQLQESGPGLVKPSETLSLTCTVSGGSISSYFWSWIR QPPGKGLEWIGYIFYSGSTNYNPSLKSRVTILVDTSKN HFSLKLSSVTAADTAVYCARVGRWELRGAFDIWGQGT MVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK 2243 | QPVLTQSSSASGTPGQRVT ISCSGSSSNIGSNTVNWYQ QFPGTAPKLLIYSNNQRPS GVPDRFSGSKSGTSASLAI SGLQSEDEAEYYCAAWDDS LNSPGVFGGGTKLTVLGQP KAAPSVTLFPPSSEELQAN KATLVCLISDFYPGAVTVA WKADSSPVKAGVETTTPSK QSNNKYAASSYLSLTPEQW KSHRSYSCQVTHEGSTVEK TVAPTECS 2244 |
| 67 | VG9B383 | IgG1 | Lambda | QVQLQESGPGL VKPSETLSLTC TVSSGSISSYY WNWIRQPAGKG LEWGRIYTIG NTNYNPSLKSR VTMSIDTSKNQ FSLNLSSVTAA DTAVYFCAREG YYDSSGSFFPG AFGIWGQGTMV TVSS 2275 | SSELTQPASV SGSPGQSITI SCTGTSNDVG SYNLVSMYQQ HPGKAPKLMI YAGSKRPSGI SNRFSGSKSG NTASLTISGL QAEDEADYYC CSFAGATNVV FGGGTKLTVL 2276 | QVQLQESGPGLVKPSETLSLTCTVSSGSISSYYWNWIR QPAGKGLEWVGRIYTIGNTNYNPSLKSRVTMSIDTSKN QFSLNLSSVTAADTAVYFCAREGYYDSSGSFFPGAFGI WGQGTMVTVSSASTKGPSVFPLAPSSKSTSGGTAALGC LVKDYFPEPVTVSWNSGALTSGVHTFPAVLQSSGLYSL SSVVTVPSSSLGTQTYICNVNHKPSNTKVDKKVEPKSC DKTHTCPPCPAPELLGGPSVFLFPPKPKDTLMISRTPE VTCVVVDVSHEDPEVKFNWYVDGVEVHNAKTKPREEQY NSTYRVVSVLTVLHQDWLNGKEYKCKVSNKALPAPIEK TISKAKGQPREPQVYTLPPSREEMTKNQVSLTCLVKGF YPSDIAVEWESNGQPENNYKTTPPVLDSDGSFFLYSKL TVDKSRWQQGNVFSCSVMHEALHNHYTQKSLSLSPGK 2277 | SSELTQPASVSGSPGQSIT ISCTGTSNDVGSYNLVSMY QQHPGKAPKLMIYAGSKRP SGISNRFSGSKSGNTASLT ISGLQAEDEADYYCCSFAG ATNVVFGGGTKLTVLGQPK AAPSVTLFPPSSEELQANK ATLVCLISDFYPGAVTVAW KADSSPVKAGVETTTPSKQ SNNKYAASSYLSLTPEQWK SHRSYSCQVTHEGSTVEKT VAPTECS 2278 |
| 68 | VG9B382 | IgG1 | Lambda | QVQLQESGPGL VKPSETLSLTC TVSGDSISGYY WNYIRQPAGKG LDWIGRIFTTG NTNYNPSLKSR VTMSVDTSKNQ FSLKLTSVTAA DTAVYCARER WDSSSSALYPD YWGQETLVTVS S 2309 | QSVLTQPPSV SGAPGQRVTI SCTGSSSNIG ADYDIKWYQQ LPGTAPKLLI YGNSNRPSGV PDRFSGSKSG TSVSLAITGL QAEDEADYYC QSYSSMSGY VVFGGGGTKLT VL 2310 | QVQLQESGPGLVKPSETLSLTCTVSGDSISGYYWNYIR QPAGKGLDWIGRIFTTGNTNYNPSLKSRVTMSVDTSKN QFSLKLTSVTAADTAVYCARERWDSSSSALYPDYWGQ GTLVTVSSASTKGPSVFPLAPSSKSTSGGTAALGCLVK DYFPEPVTVSWNSGALTSGVHTFPAVLQSSGLYSLSSV VTVPSSSLGTQTYICNVNHKPSNTKVDKKVEPKSCDKT HTCPPCPAPELLGGPSVFLFPPKPKDTLMISRTPEVTC VVVDVSHEDPEVKFNWYVDGVEVHNAKTKPREEQYNST YRVVSVLTVLHQDWLNGKEYKCKVSNKALPAPIEKTIS KAKGQPREPQVYTLPPSREEMTKNQVSLTCLVKGFYPS DIAVEWESNGQPENNYKTTPPVLDSDGSFFLYSKLTVD KSRWQQGNVFSCSVMHEALHNHYTQKSLSLSPGK 2311 | QSVLTQPPSVSGAPGQRVT ISCTGSSSNIGADYDIKWY QQLPGTAPKLLIYGNSNRP SGVPDRFSGSKSGTSVSLA ITGLQAEDEADYYCQSYDS SMSGYVFGGGTKLTVLGQ PKAAPSVTLFPPSSEELQA NKATLVCLISDFYPGAVTV AWKADSSPVKAGVETTTPS KQSNNKYAASSYLSLTPEQ WKSHRSYSCQVTHEGSTVE KTVAPTECS 2312 |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| 69 | VG9B156 | IgG1 | Lambda | QVQLQESGPGL MKPSETLSLTC TVSNGSISGYF WNWIRQPPGKG LEWIGYIFYSG STNYNPSLKSR VTISVDTSKNL VSLKLNSVTAA DTAVYFCAKLG KWELRTAPDIW GQGTMVTVSS 2343 | QLVLTQPPSA SGTPGQRVTI SCSGSTSNIG SDTVNWYQQL PGTAPKLLIY SNNQRPSGVP DRFSGSKSGT SASLAISGLQ SEDETDYYCA AWDDSLNGPV FGGGTKVTVL 2344 | QVQLQESGPGLMKPSETLSLTCTVSNGSISGYFWNWIR QPPGKGLEWIGYIFYSGSTNYNPSLKSRVTISVDTSKN LVSLKLNSVTAADTAVYFCAKLGKWELRTAPDIWGQGT MVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK 2345 | QLVLTQPPSASGTPGQRVT ISCSGSTSNIGSDTVNWYQ QLPGTAPKLLIYSNNQRPS GVPDRFSGSKSGTSASLAI SGLQSEDETDYYCAAWDDS LNGPVFGGGTKVTVLGQPK AAPSVTLFPPSSEELQANK ATIVCLISDFYPGAVTVAW KADSSPVKAGVETTTPSKQ SNNKYAASSYLSLTPEQWK SHRSYSCQVTHEGSTVEKT VAPTECS 2346 |
| 70 | VG9B205 | IgG1 | Lambda | QVQLVQSGPGL MKPSETLSLTC TVSNGSISGYF WNWIRQPPGKG LEWIGYIFYSG STNYNPSLKSR VTISVDTSKNL VSLKLNSVTAA DTAVYFCAKLG KWELRTAFDIW GQGTMVTVSS 2377 | SSELTQPPSV SVSPGQTASI TCSGDKLGDK YACWYQQKPG QSPVLVIYQD SKRPSGIPER FSGSNSGNTA TLTISGTQAM DEADYCQAW DSSTVFGGG TKLTVL 2378 | QVQLVQSGPGLMKPSETLSLTCTVSNGSISGYFWNWIR QPPGKGLEWIGYIFYSGSTNYNPSLKSRVTISVDTSKN LVSLKLNSVTAADTAVYFCAKLGKWELRTAPDIWGQGT MVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK 2379 | SSELTQPPSVSVSPGQTAS ITCSGDKLGDKYACWYQQK PGQSPVLVIYQDSKRPSGI PERFSGSNSGNTATLTISG TQAMDEADYYCQAWDSSTV VFGGGTKLTVLGQPKAAPS VTLFPPSSEELQANKATLV CLISDFYPGAVTVAWKADS SPVKAGVETTTPSKQSNNK YAASSYLSLTPEQWKSHRS YSCQVTHEGSTVEKTVAPT ECS 2380 |
| 71 | VG9B86 | IgG1 | Kappa | QVQLQESGPGL VKPSETLSLTC TVSGDSISSSY WSWIRQPAGKG LECIGRFYSSG STSYNPSLKSR VTMAIDTSKNQ FSLKLTSVTAA DTAVYYCARYS GSYWYFDLWGR GTTVTVSS 2411 | EIVLTQSPAT LSLSPGERAT LSCRASQSVS SYLAWYQQRP GQAPRLLIYD TSNRATGIPA RFSGSGSGTD FTLTISSLAP EDFAVYYCQQ RSDWLLTFGG GTKVEIK 2412 | QVQLQESGPGLVKPSETLSLTCTVSGDSISSSYWSWIR QPAGKGLECIGRFYSSGSTSYNPSLKSRVTMAIDTSKN QFSLKLTSVTAADTAVYYCARYSGSYWYFDLWGRGTTV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRM QQGNVFSCSVMHEALHNHYTQKSLSLSPGK 2413 | EIVLTQSPATLSLSPGERA TLSCRASQSVSSYLAWYQQ RPGQAPRLLIYDTSNRATG IPARFSGSGSGTDFTLTIS SLAPEDFAVYYCQQRSDWL LTFGGGTKVEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 2414 |
| 72 | VG9B154 | IgG1 | Lambda | QVQLQESGPGL VKPSETLSLTC TVSGGSISYF WNWIRQPPGKG LEWIGYIYYSG 2411 | QSALTQPPSA SGTPGQRVTI SCSGSSSNIG SNTVNWYQQL PGTAPKLLIY | QVQLQESGPGLVKPSETLSLTCTVSGGSISYFWNWIR QPPGKGLEWIGYIYYSGSTNYNPSLKSRVTISLDTSKN QFSLKLSSVTAADTAVYYCAREGKSKSTSGGTAALGCLVKDY FPEPVTVSWNSGALTSGVHTFPAVLQSSGLYSLSSVVT | QSALTQPPSASGTPGQRVT ISCSGSSSNIGSNTVNWYQ QLPGTAPKLLIYSNNQRPS GVPDRFSGSKSGTSASLAI SGLQSEDEADYYCAAWDDS |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | STNYNPSLKSR VTISLDTSKNQ FSLKLSSVTAA DTAVYCAREG KWELRTTFDIW GQGTMVTVSS 2445 | SNNQRPSGVP DRFSGSKSGT SASLAISGLQ SEDEADYYCA AWDDSLNGPV FGGGTKLTVL 2446 | VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK 2447 | LNGPVFGGGTKLTVLGQPK AAPSVTLFPPSSEELQANK ATLVCLISDFYPGAVTVAW KADSSPVKAGVETTPSKQ SNNKYAASSYLSLTPEQWK SHRSYSCQVTHEGSTVEKT VAPTECS 2448 |
| 73 | VG9B159 | IgG1 | Lambda | EVQLVQSGPGL VKPSETLSLTC TVSGGSISSYY WSWIRQPAGKG LEWIGRFYTGG RNNYNPSFKSR VTMSVDTSQNQ FSLKLSSVTAA DTAVYYCARDM EYYDRSGYSY WYFDLWGRGTT VTVSS 2479 | SYELMQPPSV SVAPGQTARI TCGGNNIGSK SVHWYQQKPG QAPVLVVYDD SDRPSGIPER FSGSNSGNTA TLTISRVEAG DEADYCQVW DSSSDHVFG GGTKLTVL 2480 | EVQLVQSGPGLVKPSETLSLTCTVSGGSISSYYWSWIR QPAGKGLEWIGRFYTGGRNNYNPSFKSRVTMSVDTSQN QFSLKLSSVTAADTAVYYCARDMEYYDRSGYSYWYFD LWGRGTTVTVSSASTKGPSVFPLAPSSKSTSGGTAALG CLVKDYFPEPVTVSWNSGALTSGVHTFPAVLQSSGLYS LSSVVTVPSSSLGTQTYICNVNHKPSNTKVDKKVEPKS CDKTHTCPPCPAPELLGGPSVFLFPPKPKDTLMISRTP EVTCVVVDVSHEDPEVKFNWYVDGVEVHNAKTKPREEQ YNSTYRVVSVLTVLHQDWLNGKEYKCKVSNKALPAPIE KTISKAKGQPREPQVYTLPPSREEMTKNQVSLTCLVKG FYPSDIAVEWESNGQPENNYKTTPPVLDSDGSFFLYSK LTVDKSRWQQGNVFSCSVMHEALHNHYTQKSLSLSPGK 2481 | SYELMQPPSVSVAPGQTAR ITCGGNNIGSKSVHWYQQK PGQAPVLVVYDDSDRPSGI PERFSGSNSGNTATLTISR VEAGDEADYYCQVWDSSSD HVVFGGGTKLTVLGQPKAA PSVTLFPPSSEELQANKAT LVCLISDFYPGAVTVAWKA DSSPVKAGVETTTPSKQSN NKYAASSYLSLTPEQWKSH RSYSCQVTHEGSTVEKTVA PTECS 2482 |
| 74 | VG9B465 | IgG1 | Lambda | QVQLQQSGPGL VKPSETLSLTC TVSGGSITSYY WNWIRQPAGKG LEWIGRIYITIG NTNYNPSLKSR VTMSIDTSKHQ FSLKLSSVTGA DTAVYYCAREG YYESDGSFFPG AFNIWGQGTMV TVSS 2513 | SSELTQPASV SGSPGQYITI SCTGTSNDVG SYNLVSWYQQ HPGKAPKLMI YAGSKRPSGI SNRFSGSKSG NTASLTISGL QAEDEADYYC CSYAGTTNVV FGGGTKVTVL 2514 | QVQLQQSGPGLVKPSETLSLTCTVSGGSITSYYWNWIR QPAGKGLEWIGRIYITIGNTNYNPSLKSRVTMSIDTSKH QFSLKLSSVTGADTAVYYCAREGYYESDGSFFPGAFNI WGQGTMVTVSSASTKGPSVFPLAPSSKSTSGGTAALGC LVKDYFPEPVTVSWNSGALTSGVHTFPAVLQSSGLYSL SSVVTVPSSSLGTQTYICNVNHKPSNTKVDKKVEPKSC DKTHTCPPCPAPELLGGPSVFLFPPKPKDTLMISRTPE VTCVVVDVSHEDPEVKFNWYVDGVEVHNAKTKPREEQY NSTYRVVSVLTVLHQDWLNGKEYKCKVSNKALPAPIEK TISKAKGQPREPQVYTLPPSREEMTKNQVSLTCLVKGF YPSDIAVEWESNGQPENNYKTTPPVLDSGSFFLYSKL TVDKSRWQQGNVFSCSVMHEALHNHYTQKSLSLSPGK 2515 | SSELTQPASVSGSPGQSIT ISCTGTSNDVGSYNLVSWY QQHPGKAPKLMIYAGSKRP SGISNRFSGSKSGNTASLT ISGLQAEDEADYYCCSYAG TTNVVFGGGTKVTVLGQPK AAPSVTLFPPSSEELQANK ATLVCLISDFYPGAVTVAW KADSSPVKAGVETTPSKQ SNNKYAASSYLSLTPEQWK SHRSYSCQVTHEGSTVEKT VAPTECS 2516 |
| 75 | VG9B194 | IgG1 | Lambda | EVQLLESGAEV KKPGASVKVSC KASGYTFTGDY MHWVRQAPGQG LEWMGWINPNS GYTNNAEKPQG RVTMTRDTSIS TAYMELSRLSS DDTAVYYCTRE LDALDVWGQGT MVTVSS | QSVLTQPPSA SGSPGQSVTI SCTGTSSDVG GYNYVSWYQQ HPGKAPKLMI YEVSKRPSGV PDRFSGSKSG NTASLTVSGL QAEDEADYYC NSYAGSNNFE VFGGGTKVTV | EVQLLESGAEVKKPGASVKVSCKASGYTFTGDYMHVR QAPGQGLEWMGWINPNSGYTNNAEKPQGRVTMTRDTSI STAYMELSRLSSDDTAVYYCTRELDALDVWGQGTMVTV SSASTKGPSVFPLAPSSKSTSGGTAALGCLVKDYFPEP VTVSWNSGALTSGVHTFPAVLQSSGLYSLSSVVTVPSS SLGTQTYICNVNHKPSNTKVDKKVEPKSCDKTHTCPPC PAPELLGGPSVFLFPPKPKDTLMISRTPEVTCVVVDVS HEDPEVKFNWYVDGVEVHNAKTKPREEQYNSTYRVVSV LTVLHQDWLNGKEYKCKVSNKALPAPIEKTISKAKGQP REPQVYTLPPSREEMTKNQVSLTCLVKGFYPSDIAVEW ESNGQPENNYKTTPPVLDSDGSFFLYSKLITVDKSRWQQ | QSVLTQPPSASGSPGQSVT ISCTGTSSDVGGYNYVSWY QQHPGKAPKLMIYEVSKRP SGVPDRFSGSKSGNTASLT VSGLQAEDEADYYCNSYAG SNNFEVFGGGTKVTVLGQP KAAPSVTLFPPSSEELQAN KATLVCLISDFYPGAVTVA WKADSSPVKAGVETTTPSK QSNNKYAASSYLSLTPEQW KSHRSYSCQVTHEGSTVEK |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| 76 | VG9B182 | IgG1 | Lambda | QVQLVESGPGL VKPSETLSLTC TVSGDSINNHF WSWIRQPPGKG LEWIGFVFYNG NTNYNPSLKSR VTISIDTSKSQ FSLKLTSVTAA DTAVYYCARVG RWVLRTAPDIW GQGTMVTVSS 2547 | QSALTQPPSA SGTPGQRVTI SCSGSSSNIG SNTVNWYQQL PGTAPKLLIY SNNQRPSGVP ARFSGSKSGT SASLAISGLQ SEDEADYYCA AWDDSLNGPG VFGGGTKLTV L 2548 | QVQLVESGPGLVKPSETLSLTCTVSGDSINNHFWSWIR QPPGKGLEWIGFVFYNGNTNYNPSLKSRVTISIDTSKS QFSLKLTSVTAADTAVYYCARVGRWVLRTAPDIWGQGT MVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK 2549 | QSALTQPPSASGTPGQRVT ISCSGSSSNIGSNTVNWYQ QLPGTAPKLLIYSNNQRPS GVPARFSGSKSGTSASLAI SGLQSEDEADYYCAAWDDS LNGPGVFGGGTKLTVLGQP KAAPSVTLFPPSSEELQAN KATLVCLISDFYPGAVTVA WKADSSPVKAGVETTTPSK QSNNKYAASSYLSLTPEQW KSHRSYSCQVTHEGSTVEK TVAPTECS 2550 |
| 77 | VG9B173 | IgG1 | Lambda | QVQLQESGPGL VKPSETLSLTC TVSGGSINNYF WSWIRQPPGKG LEWIGIYYSG STNYNPSLKSR VTISVVTSMNQ FSLKLSSVTAA DTAVYYCAREG KWELRSAFDIW GQGTMVTVSS 2581 | QSVLTQPPSA SGTPGQRVTI SCSGSSSNIE SNTVNWYQQL PRTAPKLLIY SNNQRPSGST DRFSGSKSGT SASLAISGLQ SEDEADYYCT AWDDSLNRSP FGGGTKVTVL 2582 | QVQLQESGPGLVKPSETLSLTCTVSGGSINNYFWSWIR QPPGKGLEWIGIYYSGSTNYNPSLKSRVTISVVTSMN QFSLKLSSVTAADTAVYYCAREGKWELRSAFDIWGQGT MVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK 2583 | QSVLTQPPSASGTPGQRVT ISCSGSSSNIESNTVNWYQ QLPRTAPKLLIYSNNQRPS GVPDRFSGSKSGTSASLAI SGLQSEDEADYYCTAWDDS LNGPVFGGGTKVTVLGQPK AAPSVTLFPPSSEELQANK ATLVCLISDFYPGAVTVAW KADSSPVKAGVETTTPSKQ SNNKYAASSYLSLTPEQWK SHRSYSCQVTHEGSTVEKT VAPTECS 2584 |
| 78 | VG9B87 | IgG1 | Kappa | QVQLVESGAEV KKPGASVKVSC KASGYTFTSEY IHWVRQAPQGG LEWMGIINPSG GSTSYAQRFQG RVTMTRDTSTS TVYMEVNSLRS EDTAVYYCARE RGYSGSFDYW GQGTLVTVSS 2615 | EIVLTQSPSF LSASAGDRVT ITCRASQGIS SYLAWYQQK EKAPKLLIYA ASTLQSGVPS RFSGSGSGTE FTLTISSLQP EDFATYYCQQ FNSYLTFGG GTKLEIK 2616 | QVQLVESGAEVKKPGASVKVSCKASGYTFTSEYIHVR QAPGQGLEWMGIINPSGGSTSYAQRFQGRVTMTRDTST STVYMEVNSLRSEDTAVYYCARERGYSGSFDYWGQGT LVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK 2617 | EIVLTQSPSFLSASAGDRV TITCRASQGISSYLAWYQQ KPEKAPKLLIYAASTLQSG VPSRFSGSGSGTEFTLTIS SLQPEDFATYYCQQFNSYS LTFGGGTKLEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 2618 |
| 79 | VG9B208 | IgG1 | Lambda | QVQLQESGPGL VKPSETLSLTC TVSGGSISGYY 2649 | QSVLTQPPSV SAAPGQKVTI SCSGSTSNIG 2650 | QVQLQESGPGLVKPSETLSLTCTVSGGSISGYYWSWIR QPPGKGLELIGYIFYSGSINVNPSLKNRVTISLDTSKN QFSLKLTSVTAADTAVYYCARVGKWELRSSPDIWGQGT 2651 | QSVLTQPPSVSAAPGQKVT ISCSGSTSNIGNNDVSWYQ QLPGTAPKLLIYDNNKRPS 2652 |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | WSWIRQPPGKG LELIGYIFYSG SINYNPSLKNR VTISLDTSKNQ FSLKLTSVTAA DTAVYYCARVG KWELRSSFDIW GQGTMVTVSS 2683 | NNDVSWYQQL PGTAPKLLIY DNNKRPSGIP DRFSGSKSGT SATLGITGLQ TGDEADYYCG TWDSSLSVWV FGGGTKLTVL 2684 | MVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK 2685 | GIPDRFSGSKSGTSATLGI TGLQTGDEADYCGTWDSS LSVWFGGGTKLTVLGQPK AAPSVTLFPPSSEELQANK ATIVCLISDFYPGAVTVAW KADSSPVKAGVETTTPSKQ SNNKYAASSYLSLTPEQWK SHRSYSCQVTHEGSTVEKT VAPTECS 2686 |
| 80 | VG9B372 | IgG1 | Kappa | QVQLQESGPGL VKPSQTLSLTC TVSGGSISNGG FYWSWIRQHPG KGLEWLGYINY SGSTYYNPSLE SRGTISLDTSK NQFSLKLRSVT AADTAVYYCAR DRNYEWNFDLW GRGTLVTVSS 2717 | EIVMTQSPAT LSLSPGEGAT LSCRASQSVS SYLAWYQQKP GQAPRLLVYD ASNRATGIPA RFSGSGSGTA FTLTITSLEP EDFVVYYCQQ RSNWPLTFGG GTKLEIK 2718 | QVQLQESGPGLVKPSQTLSLTCTVSGGSISNGGFYWSW IRQHPGKGLEWLGYINYSGSTYYNPSLESRGTISLDTS KNQFSLKLRSVTAADTAVYYCARDRNYEWNFDLWGRGT LVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK 2719 | EIVMTQSPATLSLSPGEGA TLSCRASQSVSSYLAWYQQ KPGQAPRLLVYDASNRATG IPARFSGSGSGTAFTLTIT SLEPEDFVVYYCQQRSNWP LTFGGGTKLEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 2720 |
| 81 | VG9B186 | IgG1 | Lambda | QVTLRESGPVL VKPTETLTLTC TVSGFSLTNIR MSVSWIRQPPG EALEWLAHIFS NDEKSYNSSLK SRLITISRDTSK SQVVLTLTNVD PVDTATYYCAR MRLPYGMDVWG QGTMVTVSS 2751 | QSVLTQPPSA SGTPGQRVTI SCSGSTSNIG SNTVNWYQQL PGTAPKLLIY SNNQRPSGVP DRFSGSKSGT SASLAISGLQ SEDEADFYCA AWDDSLNGPV FGGGTKVTVL 2752 | QVTLRESGPVLVKPTETLTLTCTVSGFSLTNIRMSVSW IRQPPGEALEWLAHIFSNDEKSYNSSLKSRLITISRDTS KSQVVLTLTNVDPVDTATYYCARMRLPYGMDVWGQGTM VTVSSASTKGPSVFPLAPSSKSTSGGTAALGCLVKDYF PEPVTVSWNSGALTSGVHTFPAVLQSSGLYSLSSVVTV PSSSLGTQTYICNVNHKPSNTKVDKKVEPKSCDKTHTC PPCPAPELLGGPSVFLFPPKPKDTLMISRTPEVTCVVV DVSHEDPEVKFNWYVDGVEVHNAKTKPREEQYNSTYRV VSVLTVLHQDWLNGKEYKCKVSNKALPAPIEKTISKAK GQPREPQVYTLPPSREEMTKNQVSLTCLVKGFYPSDIA VEWESNGQPENNYKTTPPVLDSDGSFFLYSKLTVDKSR WQQGNVFSCSVMHEALHNHYTQKSLSLSPGK 2753 | QSVLTQPPSASGTPGQRVT ISCSGSTSNIGSNTVNWYQ QLPGTAPKLLIYSNNQRPS GVPDRFSGSKSGTSASLAI SGLQSEDEADFYCAAWDDS LNGPVFGGGTKVTVLGQPK AAPSVTLFPPSSEELQANK ATIVCLISDFYPGAVTVAW KADSSPVKAGVETTTPSKQ SNNKYAASSYLSLTPEQWK SHRSYSCQVTHEGSTVEKT VAPTECS 2754 |
| 82 | VG9B177 | IgG1 | Lambda | QVQLQESGPGL VKPSETLSLTC TVSGGSINNYF WSWIRQPPGKG LEWIGYIFYSG STNYNPSLKSR VTISIDTSKNQ FSLKVNSVTAA DTAVYYCARVG 2751 | QSALTQPASV SGSPGQSITI SCTGTSSDVA DYNYVSWYQQ HPGKAPKLMI YEVSNRPSGV SNRFSGSKSG NTASLTISGL QAEDEADYYC 2752 | QVQLQESGPGLVKPSETLSLTCTVSGGSINNYFWSWIR QPPGKGLEWIGYIFYSGSTNYNPSLKSRVTISIDTSKN QFSLKVNSVTAADTAVYYCARVGKWELRTAPDIWGQGT MVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA | QSALTQPASVSGSPGQSIT ISCTGTSSDVADYNYVSWY QQHPGKAPKLMIYEVSNRP SGVSNRFSGSKSGNTASLT ISGLQAEDEADYYCCSYTS SFTVVFGGGTKVTVLGQPK ATIVCLISDFYPGAVTVAW KADSSPVKAGVETTTPSKQ |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| 83 | VG9B114 | IgG1 | Kappa | KWELRTAPDIW GQGTMVTVSS 2785 | CSYTSSFTVV FGGGTKVTVL 2786 | KGQPREPQVTLPPSREEMTKNQVSLTCLVKGFYPSDI AVEWESNGQPENNYKTTPPVLDSDGFFLYSKLTVDKS RWQQGNVFSCSVMHEALHNHYTQKSLSLSPGK 2787 | SNNKYAASSYLSLTPEQWK SHRSYSCQVTHEGSTVEKT VAPTECS 2788 |
| 84 | VG9B147 | IgG1 | Lambda | EVQLVESGGDL VQPGGSLRLSC AASGFTFSRYD MHWVRQATGKG LEWVSAIGSAG DTYYPGSVKGR FTISRENAKNS LYLQMNSLRAG DTAYYCARGK WELRDAPDIWG QGTMVTVSS 2819 | DIVMTQSPSF LSASVGDRVT ITCRASQGIH SYLAWYQQKP GKAPKLLIYV ASTLQSGVPS RFSGSRSGTE FTLTISSLQP EDFATYYCQQ LNSYPYTFGQ GTKLEIK 2820 | EVQLVESGGDLVQPGGSLRLSCAASGFTFSRYDMHWVR QATGKGLEWVSAIGSAGDTYYPGSVKGRFTISRENAKN SLYLQMNSLRAGDTAVYYCARGKWELRDAPDIWGQGTM VTVSSASTKGPSVFPLAPSSKSTSGGTAALGCLVKDYF PEPVTVSWNSGALTSGVHTFPAVLQSSGLYSLSSVVTV PSSSLGTQTYICNVNHKPSNTKVDKKVEPKSCDKTHTC PPCPAPELLGGPSVFLFPPKPKDTLMISRTPEVTCVVV DVSHEDPEVKFNWYVDGVEVHNAKTKPREEQYNSTYRV VSVLTVLHQDWLNGKEYKCKVSNKALPAPIEKTISKAK GQPREPQVYTLPPSREEMTKNQVSLTCLVKGFYPSDIA VEWESNGQPENNYKTTPPVLDSDGFFLYSKLTVDKSR WQQGNVFSCSVMHEALHNHYTQKSLSLSPGK 2821 | DIVMTQSPSFLSASVGDRV TITCRASQGIHSYLAWYQQ KPGKAPKLLIVVASTLQSG VPSRFSGSRSGTEFTLTIS SLQPEDFATYYCQQLNSYP YTFGQGTKLEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 2822 |
| 84 | VG9B147 | IgG1 | Lambda | QVQLQESGPGL VNPSETLSLTC TVSGGSISGYF WNWIRQPPGKG LEWIGYIFYSG STNYNPSLKSR VTISVDTSKNQ FSLKLSSVTAA DTAIYYCAREG KWELRSTFDIW GQGTMVTVSS 2853 | SSELTQDPAV SVALGQTVRI TCQGDSLRSY YATWYQQKPG QAPILVIYGE NNRPSGIPDR FSGSRSGNTA SLTITGAQAE DEADYYCNSR DTGDHHLVFG GGTKLTVL 2854 | QVQLQESGPGLVNPSETLSLTCTVSGGSISGYFWNWIR QPPGKGLEWIGYIFYSGSTNYNPSLKSRVTISVDTSKN QFSLKLSSVTAADTAIYYCAREGKWELRSTFDIWQGGT MVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGFFLYSKLTVDKS RWQQGNVFSCSVMHEALHNHYTQKSLSLSPGK 2855 | SSELTQDPAVSVALGQTVR ITCQGDSLRSYYATWYQQK PGQAPILVIYGENNRPSGI PDRFSGSRSGNTASLTITG AQAEDEADYYCNSRDTGDH HLVFGGGTKLTVLGQPKAA PSVTLFPPSSEELQANKAT LVCLISDFYPGAVTVAWKA DSSPVKAGVETTTPSKQSN NKYAASSYLSLTPEQWKSH RSYSCQVTHEGSTVEKTVA PTECS 2856 |
| 85 | VG9B65 | IgG1 | Kappa | QVQLVQSGAEV KKPGSSVKVSC KASGGTFNIYA INWVRQAPGQG LEWMGGIIPFF GTANYAQKFQD RVTITADKSTN TAYMELSSLRS EDTAVFYCARG GDSGYDWGFDY WGQGTLVTVSS 2887 | DIVMTQTPLS SPVTLGQPAS ISCRSSQSLV HSDGNTYLSW LQQRPGQPPR LLIYQISNRF SGVPDRPSGS GAGTDFTLNI SRVEADDVGV YYCMQATQFP LTFGGGTKVE IK 2888 | QVQLVQSGAEVKKPGSSVKVSCKASGGTFNIYAINWVR QAPGQGLEWMGGIIPFFGTANYAQKFQDRVTITADKST NTAYMELSSLRSEDTAVFYCARGGDSGYDWGFDYWGQG TLVTVSSASTKGPSVFPLAPSSKSTSGGTAALGCLVKD YFPEPVTVSWNSGALTSGVHTFPAVLQSSGLYSLSSVV TVPSSSLGTQTYICNVNHKPSNTKVDKKVEPKSCDKTH TCPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMTKNQVSLTCLVKGFYPSD IAVEWESNGQPENNYKTTPPVLDSDGFFLYSKLTVDK SRWQQGNVFSCSVMHEALHNHYTQKSLSLSPGK 2889 | DIVMTQTPLSSPVTLGQPA SISCRSSQSLVHSDGNTYL SWLQQRPGQPPRLLIYQIS NRFSGVPDRFSGSGAGTDF TLNISRVEADDVGVYYCMQ ATQFPLTFGGGTKVEIKRT VAAPSVFIFPPSDEQLKSG TASVVCLLNNFYPREAKVQ WKVDNALQSGNSQESVTEQ DSKDSTYSLSSTLTLSKAD YEKHKVYACEVTHQGLSSP VTKSFNRGEC 2890 |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| 86 | VG9B81 | IgG1 | Kappa | QVQLQESGPGL VKPSETLSLTC SVSGGSINTYY WSWFRQPAGKG LELIGRIYTSD NTNYNPSLKSR VTMSVDTSKNQ FSLKLSSVTAA DTAVYYCARYN WNYWFDLWGR GTLVTVSS 2921 | DIQMTQSPSF LSASVRDRVN ITCRASQGIS SYLAWYQQKP GKAPKLLIYT ASTLQSGVPS RFSGSGSGTE FTLTISSLQP EDFATYYCQH LNSYPTFGQ GTKVEIK 2922 | QVQLQESGPGLVKPSETLSLTCSVSGGSINTYYWSWFR QPAGKGLELIGRIYTSDNTNYNPSLKSRVTMSVDTSKN QFSLKLSSVTAADTAVYYCARYNWNYWFDLWGRGTLV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 2923 | DIQMTQSPSFLSASVRDRV NITCRASQGISSYLAWYQQ KPGKAPKLLIYTASTLQSG VPSRFSGSGSGTEFTLTIS SLQPEDFATYYCQHLNSYP TFGQGTKVEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 2924 |
| 87 | VG9B203 | IgG1 | Lambda | QVQLVQSGPGL VKPSETLSLTC TVSGDSIGHYY WNWIRQPAGKG LEWIGRIYTSG STNYNPSLKSR VTMSVDTSKNQ FSLKLSSVTAA DTAVYYCARSG GNFYWYFDLWG RGTLVTVSS 2955 | QSVLTQPPSV SAAPGQKVTI SCSGSSSNIG NNYVSWYQQV PGTAPKLLIY DNNKRPSGIP DRISGSKSGT SATLGITGLQ TGDEADYYCG TWDSSLSAGV FGGGTKVTVL 2956 | QVQLVQSGPGLVKPSETLSLTCTVSGDSIGHYYWNWIR QPAGKGLEWIGRIYTSGSTNYNPSLKSRVTMSVDTSKN QFSLKLSSVTAADTAVYYCARSGGNFYWYFDLWGRGTL VTVSSASTKGPSVFPLAPSSKSTSGGTAALGCLVKDYF PEPVTVSWNSGALTSGVHTFPAVLQSSGLYSLSSVVTV PSSSLGTQTYICNVNHKPSNTKVDKKVEPKSCDKTHTC PPCPAPELLGGPSVFLFPPKPKDTLMISRTPEVTCVVV DVSHEDPEVKFNWYVDGVEVHNAKTKPREEQYNSTYRV VSVLTVLHQDWLNGKEYKCKVSNKALPAPIEKTISKAK GQPREPQVYTLPPSREEMTKNQVSLTCLVKGFYPSDIA VEWESNGQPENNYKTTPPVLDSDGSFFLYSKLTVDKSR WQQGNVFSCSVMHEALHNHYTQKSLSLSPGK 2957 | QSVLTQPPSVSAAPGQKVT ISCSGSSSNIGNNYVSWYQ QVPGTAPKLLIYDNNKRPS GIPDRISGSKSGTSATLGI TGLQTGDEADYYCGTWDSS LSAGVFGGGTKVTVLGQPK AAPSVTLFPPSSEELQANK ATIVCLISDFYPGAVTVAW KADSSPVKAGVETTTPSKQ SNNKYAASSYLSLTPEQWK SHRSYSCQVTHEGSTVEKT VAPTECS 2958 |
| 88 | VG9B380 | IgG1 | Lambda | QVQLQESGPGL VKPSETLSLTC TVSGGSISNYY WSWIRQPAGKG LEWIGRIYPSG ITSTPSLKSR VTMSLDTSKNQ FSLKLTSVTAA DTAVYYCAGIM GTKGAFDIWGQ GTMVTVSS 2989 | QSALTQPASV SGSPGQSIT SCTGTSSDVG GYNYVSWYQQ HPGKAPKLLI YEVSNRPGQS SNRFSGSKSG STASLTISGL QAEDEADYYC SSYTSTSVVF GGGTKLTVL 2990 | QVQLQESGPGLVKPSETLSLTCTVSGGSISNYYWSWIR QPAGKGLEWIGRIYPSGITSYDPSLKSRVTMSLDTSKN QFSLKLTSVTAADTAVYYCAGIMGTKGAFDIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 2991 | QSALTQPASVSGSPGQSIT ISCTGTSSDVGGYNYVSWY QQHPGKAPKLLIYEVSNRP SGVSNRFSGSKSGSTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS NNKYAASSYLSLTPEQWKS HRSYSCQVTHEGSTVEKTV APTECS 2992 |
| 89 | VG9B103 | IgG1 | Kappa | EVQLVQSGAEV KKPGSSVKVSC KTSGGTFSSYA ISWRQAPGQG LEWMGGIIPIF 2989 | ETTLTQSPLS SPVTLGQPAS ISCRSSQGLV HSDGNTYLSW LQQRPGQSPR 2990 | EVQLVQSGAEVKKPGSSVKVSCKTSGGTFSSYAISWVR QAPGQGLEWMGGIIPIFGTATYAQKFQDRVTITADKST STAYMELSSLRSEDTAVFYCARGVGWGTDYYYGLDVWG QGTTVTVSSASTKGPSVFPLAPSSKSTSGGTAALGCLV KDYFPEPVTVSWNSGALTSGVHTFPAVLQSSGLYSLSS | ETTLTQSPLSSPVTLGQPA SISCRSSQGLVHSDGNTYL SWLQQRPGQSPRLLIYKIS NRFSGVPDRFSGSGAGTDF TLKISRVEAEDVGVYYCMQ 2992 |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| 90 | VG9B462 | IgG1 | Lambda | GTATYAQKFQD RVTITADKSTS TAYMELSSLRS EDTAVFYCARG VGWGTDYYYGL DVWGQGTTVTV SS 3023 | LLIYKLSNRF SGVPDRFSGS GAGTDFTLKI SRVEAEDVGV YYCMQATHHP LTFGGGTKVE IK 3024 | VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 3025 | ATHHPLTFGGGTKVEIKRT VAAPSVFIFPPSDEQLKSG TASVVCLLNNFYPREAKVQ WKVDNALQSGNSQESVTEQ DSKDSTYSLSSTLTLSKAD YEKHKVYACEVTHQGLSSP VTKSFNRGEC 3026 |
| 91 | VG9B461 | IgG1 | Lambda | QVQLQQSGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS 3057 | QSVLTQPASV SGSPGQSITI SCTGTSSDVG GYNYVSWYQQ HPGKAPKLMI YEVSNRPSGV SNRFSGSKSG NTASLITSGL QAEDEADYYC SSYTSTSVVF GGGTKLTVL 3058 | QVQLQQSGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3059 | QSVLTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS NNKYAASSYLSLTPEQWKS HRSYSCQVTHEGSTVEKTV APTECS 3060 |
| 92 | VG9B461 | IgG1 | Lambda | QVTLKESGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS 3091 | QPVLTQSSSV SGSPGQSITI SCTGTSSDVG GYNYVSWYQQ HPGKAPKLMI YEVSNRPSGV SNRFSGSKSG NTASLITSGL QAEDEADYYC SSYTSTSVVF GGGTKVTVL 3092 | QVTLKESGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3093 | QPVLTQSSSVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKVTVLGQPKA APSVTLFPPSSEELQANKA TLVCLISDFYPGAVTVAWK ADSSPVKAGVETTTPSKQS NNKYAASSYLSLTPEQWKS HRSYSCQVTHEGSTVEKTV APTECS 3094 |
| 92 | VG9B106 | IgG1 | Kappa | EVQLVQSGAEV KKPGASVKVSC KASGYTFTGYY LHWVRQAPGQG LEWVGWINPSS GDTDYAQTFQG RVTMTRDTSIS TAYMELSRLRS DDTAVYYCANE LGIGVFDYWGQ GTLVTVSS | DIVMTQSPDS LAVSLGERAT INCKSSQSVL YSSNNKNYLG WYQQKPGQPP KLLIYWASTR ESGVPDRFSG SGSGTDFTLT ISSLQAEDVA VYFCQQYYSI PYTFGQGTKV | EVQLVQSGAEVKKPGASVKVSCKASGYTFTGYYLHWVR QAPGQGLEWVGWINPSSGDTDYAQTFQGRVTMTRDTSI STAYMELSRLRSDDTAVYYCANELGIGVFDYWGQGTLV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW | DIVMTQSPDSLAVSLGERA TINCKSSQSVLYSSNNKNY LGMYQQKPGQPPKLLIYWA STRESGVPDRFSGSGSGTD FTLTISSLQAEDVAVYFCQ QYYSIPYTFGQGTKVDIKR TVAAPSVFIFPPSDEQLKS GTASVVCLLNNFYPREAKV QMKVDNALQSGNSQESVTE QDSKDSTYSLSSTLTLSKA DYEKHKVYACEVTHQGLSS |

TABLE 2-continued

VH and VL Amino Acid Sequences

| # | Protein Name | HC Isotype | LC Isotype | VH AA sequence | Heavy Chain AA sequence | VL AA sequence | Light Chain AA sequence |
|---|---|---|---|---|---|---|---|
| 93 | VG9B115 | IgG1 | Kappa | QVTLRESGPTL VKPTQTLTLTC TFSGFSLSTYG VGVGWIRQPPG KALEWLALIYW NDDKRYNPSLK SRLTITKDTSK NQVVLTMTNMD PVGTATYYCSH ESDWSYYFDYW GQGTMVTVSS 3125 | QVTLRESGPTLVKPTQTLTLTCTFSGFSLSTYGVGVGW IRQPPGKALEWLALIYWNDDKRYNPSLKSRLTITKDTS KNQVVLTMTNMDPVGTATYYCSHESDWSYYFDYWGQGT MVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK 3127 | EIVLTQSPAT LSLSPGERAT LSCRASQSVS SYLAWYQQKP GLAPRLLIYD ASNRATGIPA RFSGSGSGTD FTLTISSLEP VDFAVYYCQQ RSSWPWTFGQ GTKVDIK 3126 | EIVLTQSPATLSLSPGERA TLSCRASQSVSSYLAWYQQ KPGLAPRLLIYDASNRATG IPARFSGSGSGTDFTLTIS SLEPVDFAVYYCQQRSSWP WTFGQGTKVDIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 3162 |
| 94 | VG9B27 | IgG1 | Kappa | EVQLVQSGAEV KKPGSSVKVSC KASGTFSSYV ISWVRQAPGQG LEWMGGILPIL STANYAQKFQG RVTITADKSTS TAYMELSSLRS EDTAVYYCARA HDYYGMDVWG QGTMVTVSS 3159 | EVQLVQSGAEVKKPGSSVKVSCKASGTFSSYVISWVR QAPGQGLEWMGGILPILSTANYAQKFQGRVTITADKST STAYMELSSLRSEDTAVYYCARAHDYYGMDVWGQGTM VTVSSASTKGPSVFPLAPSSKSTSGGTAALGCLVKDYF PEPVTVSWNSGALTSGVHTFPAVLQSSGLYSLSSVVTV PSSSLGTQTYICNVNHKPSNTKVDKKVEPKSCDKTHTC PPCPAPELLGGPSVFLFPPKPKDTLMISRTPEVTCVV DVSHEDPEVKFNWYVDGVEVHNAKTKPREEQYNSTYRV VSVLTVLHQDWLNGKEYKCKVSNKALPAPIEKTISKAK GQPREPQVYTLPPSREEMTKNQVSLTCLVKGFYPSDIA VEWESNGQPENNYKTTPPVLDSDGSFFLYSKLTVDKSR WQQGNVFSCSVMHEALHNHYTQKSLSLSPGK 3161 | DIVMTQTPLS SPVTLGQPAS ISCRSSQSLV HSDGNTYLSW LQQRPGQPPR LLIYKISNRF SGVPDRFSGS GAGTDFTLKI SRVEAEDVGI YYCMQATHHP LTFGGGTKLE IK 3160 | DIVMTQTPLSSPVTLGQPA SISCRSSQSLVHSDGNTYL SWLQQRPGQPPRLLVYKIS NRFSGVPDRFSGSGAGTDF TLKISRVEAEDVGIYYCMQ ATHHPLTFGGGTKLEIKRT VAAPSVFIFPPSDEQLKSG TASVVCLLNNFYPREAKVQ WKVDNALQSGNSQESVTEQ DSKDSTYSLSSTLTLSKAD YEKHKVYACEVTHQGLSSP VTKSFNRGEC 3196 |
| 95 | VG9B458 | IgG1 | Lambda | QVQLVQSGPGL VKPSETLSLTC TVSGSGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS 3193 | QVQLVQSGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3195 | QSVLTQPASV SGSPGQSITI SCTGTSSDVG GYNYVSWYQQ HPGKAPKLMI YEVSNRPSGV SNRFSGSKSG NTASLTISGL QAEDEADYYC SSYTSTSVVF GGGTKLTVL 3194 | QSVLTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS NNKYAASSYLSLTPEQWKS HRSYSCQVTHEGSTVEKTV APTECS 3230 |
| 96 | VG9B131 | IgG1 | Kappa | QVQLVQSGGTL VQPGGSLRLSC AVSGFTFSSYD | QVQLVQSGGTLVQPGGSLRLSCAVSGFTFSSYDMNWVR QAPGKGLEWVSYISSSSTAKYADSVKGRFTISRDNAK NSLYLQMNSLWDEDTAVYYCAREDIVVTPILQHWQGG 3229 | EIVMTQSPAT LSLSPGERAT LSCRASQSVS 3228 | EIVMTQSPATLSLSPGERA TLSCRASQSVSNYLAWYQQ KSGQAPRLLIYDASNRATG |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | MNWVRQAPGKG LEWVSYISSSS TAKYYADSVKG RFTISRDNAKN SLYLQMNSLWD EDTAVYYCARE DIVVTPILQH WGQGTLVTVSS | NYLAWYQQKS GQAPRLLIYD ASNRATGIPA RFSGSGSGTD FTLTISSLEP EDFAVYCCQQ RSNWTFGQGT RLEIK | TLVTVSSASTKGPSVFPLAPSSKSTSGGTAALGCLVKD YFPEPVTVSWNSGALTSGVHTFPAVLQSSGLYSLSSVV TVPSSSLGTQTYICNVNHKPSNTKVDKKVEPKSCDKTH TCPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPGK | IPARFSGSGSGTDFTLTIS SLEPEDFAVYCCQRSNWT FGQGTRLEIKRTVAAPSVF IFPPSDEQLKSGTASVVCL LNNFYPREAKVQWKVDNAL QSGNSQESVTEQDSKDSTY SLSSTLTLSKADYEKHKVY ACEVTHQGLSSPVTKSFNR GEC |
| | | | | 3261 | 3262 | 3263 | 3264 |
| 97 | VG9B163 | IgG1 | Lambda | QVQLVQSGGGL VKPGASLKLSC AASGFTFSNHG MSWVRQTSDKR LEWVASITRGG DTTYYPDNVKG RFTISRENAKN TLYLQMSSLKS DDTALYYCTRG PLTVGYAMDYW GQGTTVTVSS | QLVLTQPPSV SAAPGQKVTI SCSGNSSNIG HNYVSWQQL PGTAPKLLIY DNNQRPSGIP DRFSGSKSDT SATLGITGLQ TGDEADYYCG IWDSSLSIVV FGGGTKVTVL | QVQLVQSGGGLVKPGASLKLSCAASGFTFSNHGMSWVR QTSDKRLEWVASITRGGDTTYYPDNVKGRFTISRENAK NTLYLQMSSLKSDDTALYYCTRGPLTVGYAMDYWGQGT TVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK | QLVLTQPPSVSAAPGQKVT ISCSGNSSNIGHNYVSWQ QLPGTAPKLLIYDNNQRPS GIPDRFSGSKSDTSATLGI TGLQTGDEADYYCGIWDSS LSIVVFGGGTKVTVLGQPK AAPSVTLFPPSSEELQANK ATLVCLISDFYPGAVTVAW KADSSPVKAGVETTTPSKQ SNNKYAASSYLSLTPEQWK SHRSYSCQVTHEGSTVEKT VAPTECS |
| | | | | 3295 | 3296 | 3297 | 3298 |
| 98 | VG9B454 | IgG1 | Lambda | QVQLQESGPGL VKPSETLSLTC TVSGGSISNYY WSWIRQPAGKG LGWIGRIYSSG ITNYNPSLKSR VTMSVDTSKNQ LSLKLSSVTAA DTAVYCAGIV GVKGAFAIWGQ GTMVTVSS | QAVLTQPASV SGSPGQSITI SCTGTSSDVG GYNYVSWYQQ HPGKAPKLMI YEVSNRPGKG SNRFSGSKSG NTASLTISGL QAEDEADYYC SSYTSTVVF GGGTKLTVL | QVQLQESGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK | QAVLTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS NNKYAASSYLSLTPEQWKS HRSYSCQVTHEGSTVEKTV APTECS |
| | | | | 3329 | 3330 | 3331 | 3332 |
| 99 | VG9B439 | IgG1 | Lambda | QVQLQQSGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV | QSALTQPASV SGSPGQSITI SCTGTSSDVG GYNYVSWYQQ HPGKAPKLMI YEVSNRPSGV SNRFSGSKSG NTASLTISGL QAEDEADYYC | QVQLQQSGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNPKALPAPIEKTISKAKG | QSALTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | GVKGAFAIWGQ GTMVTVSS 3363 | SSYTSTSVVF GGGTKLTVL 3364 | QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3365 | NNKYAASSYLSLTPEQWKS HRSYSCQVTHEGSTVEKTV APTECS 3366 |
| 100 | VG9B68 | IgG1 | Kappa | EVQLVESGAEV KKPGSSVKVSC KASGTFSTYA ISWVRQAPGQG LEWMGGIIPIF GTATYAQRFQD RVMITADKSTT TAYMELSSLRS EDTAVFYCARG VGWGSDYYYGL DVWGQGTMVTV SS 3397 | EIVMTQSPLS SPVTLGQPAS ISCRSSQSLV HSDGNTYLSW LQQRPGQSPR LLIYKISNRF SGVPDRFSGS GAGTDFTLRI TRVEPEDVGV YYCIQATHHP LTFGGGTRLE IK 3398 | EVQLVESGAEVKKPGSSVKVSCKASGTFSTYAISWVR QAPGQGLEWMGGIIPIFGTATYAQRFQDRVMITADKST TAYMELSSLRSEDTAVFYCARGVGWGSDYYYGLDVWG QGTMVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 3399 | EIVMTQSPLSSPVTLGQPA SISCRSSQSLVHSDGNTYL SWLQQRPGQSPRLLIYKIS NRFSGVPDRFSGSGAGTDF TLRITRVEPEDVGVYYCIQ ATHHPLTFGGGTRLEIKRT VAAPSVFIFPPSDEQLKSG TASVVCLLNNFYPREAKVQ WKVDNALQSGNSQESVTEQ DSKDSTYSLSSTLTLSKAD YEKHKVYACEVTHQGLSSP VTKSFNRGEC 3400 |
| 101 | VG9B449 | IgG1 | Lambda | QVQLQESGPGL VKPSETLSLTC TVSGGSISNYY WSWIRQPAGKG LGWIGRIYSSG ITNYNPSLKSR VTMSVDTSKNQ LSLKLSSVTAA DTAVVYCAGIV GVKGAFAIWGQ GTMVTVSS 3431 | QAVLTQPASV SGSPGQSITI SCTGTSSDVG GYNYVSWYQQ HPGKAPKLMI YEVSNRPSGV SNRFSGSKSG NTASLTISGL QAEDEADYYC SSYTSTSVVF GGGTKVTVL 3432 | QVQLQESGPGLVKPSETLSLTCTVSGGSISNYYWSWIR QPAGKGLGWIGRIYSSGITNYNPSLKSRVTMSVDTSKN QLSLKLSSVTAADTAVVYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3433 | QAVLTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKVTVLGQPKA APSVTLFPPSSEELQANKA TLVCLISDFYPGAVTVAWK ADSSPVKAGVETTTPSKQS NNKYAASSYLSLTPEQWKS HRSYSCQVTHEGSTVEKTV APTECS 3434 |
| 102 | VG9B204 | IgG1 | Lambda | QVQLQESGPGL VKPSETLSLTC TVSYGSFSSFY WSWIRQPAGKG LEWIGRIYTSG GTIYNPSLKSR VTMSVDTSKNQ FSLKLSSVTAA DTAVVYCARML RAFDYWGQGTL VTVSS 3465 | SSELTQPPSV SVSPGQTAS TCSGDKLGDK YACWYQQKPG QSPVLVIYQD SKRPSGIPER FSGSNSGNTA TLTISGTQAM DEADYCQAW DSSTVFGGG TKLTVL 3466 | QVQLQESGPGLVKPSETLSLTCTVSYGSFSSFYWSWIR QPAGKGLEWIGRIYTSGGTIYNPSLKSRVTMSVDTSKN QFSLKLSSVTAADTAVVYCARWLRAPDYWGQGTLVTVS SASTKGPSVFPLAPSSKSTSGGTAALGCLVKDYFPEPV TVSWNSGALTSGVHTFPAVLQSSGLYSLSSVVTVPSSS LGTQTYICNVNHKPSNTKVDKKVEPKSCDKTHTCPPCP APELLGGPSVFLFPPKPKDTLMISRTPEVTCVVVDVSH EDPEVKFNWYVDGVEVHNAKTKPREEQYNSTYRVVSVL TVLHQDWLNGKEYKCKVSNKALPAPIEKTISKAKGQPR EPQVYTLPPSREEMTKNQVSLTCLVKGFYPSDIAVEWE SNGQPENNYKTTPPVLDSDGSFFLYSKLTVDKSRWQQG NVFSCSVMHEALHNHYTQKSLSLSPGK 3467 | SSELTQPPSVSVSPGQTAS ITCSGDKLGDKYACWYQQK PGQSPVLVIYQDSKRPSGI PERFSGSNSGNTATLTISG TQAMDEADYYCQAWDSSTV VFGGGTKLTVLGQPKAAPS VTLFPPSSEELQANKATIV CLISDFYPGAVTVAWKADS SPVKAGVETTTPSKQSNNK YAASSYLSLTPEQWKSHRS YSCQVTHEGSTVEKTVAPT ECS 3468 |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| 103 | VG9B459 | IgG1 | Lambda | QVQLQESGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS 3499 | QPVLTQPASV SGSPGQSITI SCTGTSSDVG GYNYVSWYQQ HPGKAPKLMI YEVSNRPSGV SNRFSGSKSG NTASLTISGL QAEDEADYYC SSYTSTSVVF GGGTKLTVL 3500 | QVQLQESGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3501 | QPVLTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS NNKYAASSYLSLTPEQWKS HRSYSCQVTHEGSTVEKTV APTECS 3502 |
| 104 | VG9B157 | IgG1 | Lambda | EVQLLESGGGL VKPGASLKLSC AASGFTFSNHG MSWVRQTSDKR LEWVASITRGG DTTYYPDNVKG RFTISRENAKN TLYLQMSSLKS DDTALYYCTRG PLTVGYAMDYW GQGTVTVSS 3533 | SSELTQDPAV SVALGQTVRI TCQGDSLRSY YATWYQQKPG QAPILVIYGE NNRPSGIPDR FSGSRSGNTA SLTITGAQAE DEADYCNSR DTGDHHLVFG GGTKLTVL 3534 | EVQLLESGGGLVKPGASLKLSCAASGFTFSNHGMSWVR QTSDKRLEWVASITRGGDTTYYPDNVKGRFTISRENAK NTLYLQMSSLKSDDTALYYCTRGPLTVGYAMDYWGQGT TVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK 3535 | SSELTQDPAVSVALGQTVR ITCQGDSLRSYYATWYQQK PGQAPILVIYGENNRPSGI PDRFSGSRSGNTASLTITG AQAEDEADYYCNSRDTGDH HLVFGGGTKLTVLGQPKAA PSVTLFPPSSEELQANKAT LVCLISDFYPGAVTVAWKA DSSPVKAGVETTTPSKQSN NKYAASSYLSLTPEQWKSH RSYSCQVTHEGSTVEKTVA PTECS 3536 |
| 105 | VG9B453 | IgG1 | Lambda | QVQLQQSGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS 3567 | QSALTQPASV SCTGTSSDVG GYNYVSWYQQ HPGKAPKLMI YEVSNRPSGV SNRFSGSKSG NTASLTISGL QAEDEADYYC SSYTSTSVVF GGGTKVTVL 3568 | QVQLQQSGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRM QQGNVFSCSVMHEALHNHYTQKSLSLSPGK 3569 | QSALTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKVTVLGQPKA APSVTLFPPSSEELQANKA TLVCLISDFYPGAVTVAWK ADSSPVKAGVETTTPSKQS NNKYAASSYLSLTPEQWKS HRSYSCQVTHEGSTVEKTV APTECS 3570 |
| 106 | VG9B443 | IgG1 | Lambda | QVQLQESGPGL VKPSETLSLTC TVSGGSISNYY WSWIRQPAGKG LGWIGRIYSSG ITNYNPSLKSR | QSALTQPASV SCTGTSSDVG GYNYVSWYQQ HPGKAPKLMI YEVSNRPSGV | QVQLQESGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP | QSALTQPASVSGSPGQSIT ISCTGTSSDVGGYNYVSWY QQHPGKAPKLMIYEVSNRP SGVSNRFSGSKSGNTASLT ISGLQAEDEADYYCSSYTS |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | VTMSVDTSKNQ LSLKLSSVTAA DTAVYYCAGIV GVKGAFAIWGQ GTMVTSS | SNRFSGSKSG NTASLTISGL QAEDEADYYC SSYTSTSVF GGGTKLTVL 3602 | SSSLGTQTYICNVNHKPSNTKDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3603 | TSVVFGGGTKLTVLGQPKA APSVTLFPPSSELQANKA TLVCLISDFYPGAVTVAWK ADSSPVKAGVETTPSKQS NNKYAASSYLSLTPEQWKS HRSYSCQVTHEGSTVEKTV APTECS 3604 |
| 107 | VG9B455 | IgG1 | Lambda | QVQLVESGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS 3635 | SYELTQPASV SGSPGQSITI SCTGTSSDVG GYNYVSWYQQ HPGKAPKLMI YEVSNRPSGV SNRFSGSKSG NTASLTISGL QAEDEADYYC SSYTSTSVF GGGTKLTVL 3636 | QVQLVESGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3637 | SYELTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSELQANKA TLVCLISDFYPGAVTVAWK ADSSPVKAGVETTPSKQS NNKYAASSYLSLTPEQWKS HRSYSCQVTHEGSTVEKTV APTECS 3638 |
| 108 | VG9B466 | IgG1 | Lambda | QVQLVQSGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS 3669 | SYELTQPASV SGSPGQSITI SCTGTSSDVG GYNYVSWYQQ HPGKAPKLMI YEVSNRPSGV SNRFSGSKSG NTASLTISGL QAEDEADYYC SSYTSTSVF GGGTKLTVL 3670 | QVQLVQSGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3671 | SYELTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSELQANKA TLVCLISDFYPGAVTVAWK ADSSPVKAGVETTPSKQS NNKYAASSYLSLTPEQWKS HRSYSCQVTHEGSTVEKTV APTECS 3672 |
| 109 | VG9B450 | IgG1 | Lambda | EVQLQESGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS | QSVLTQPASV SGSPGQSITI SCTGTSSDVG GYNYVSWYQQ HPGKAPKLMI YEVSNRPSGV SNRFSGSKSG NTASLTISGL QAEDEADYYC SSYTSTSVF GGGTKLTVL | EVQLQESGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW | QSVLTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSELQANKA TLVCLISDFYPGAVTVAWK ADSSPVKAGVETTPSKQS NNKYAASSYLSLTPEQWKS HRSYSCQVTHEGSTVEKTV |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| 110 | VG9B438 | IgG1 | Lambda | EVQLVESGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS 3703 | SYELTQPASV SGSPGQSITI SCTGTSSDVG GYNYVSWYQQ HPGKAPKLMI YEVSNRPSGV SNRFSGSKSG NTASLTISGL QAEDEADYYC SSYTSTSVVF GGGTKLTVL 3704 | EVQLVESGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3705 | SYELTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS NNKYAASSYLSLLTPEQWKS HRSYSCQVTHEGSTVEKTV APTECS 3706 |
| 111 | VG9B464 | IgG1 | Lambda | EVQLVQSGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV GVKGAFAIWGQ GTTVTVSS 3771 | QSALTQPASV SGSPGQSITI SCTGTSSDVG GYNYVSWYQQ HPGKAPKLMI YEVSNRPSGV SNRFSGSKSG NTASLTISGL QAEDEADYYC SSYTSTSVVF GGGTKLTVL 3772 | EVQLVQSGPGLVKPSETLSLTCTVSGGSISNYYWSWIR QPAGKGLGWIGRIYSSGITNYNPSLKSRVTMSVDTSKN QLSLKLSSVTAADTAVYYCAGIVGKGAFAIWGQGTTV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3773 | QSALTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS NNKYAASSYLSLLTPEQWKS HRSYSCQVTHEGSTVEKTV APTECS 3774 |
| 112 | VG9B437 | IgG1 | Lambda | EVQLQESGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS 3805 | QSALTQPASV SGSPGQSITI SCTGTSSDVG GYNYVSWYQQ HPGKAPKLMI YEVSNRPSGV SNRFSGSKSG NTASLTISGL QAEDEADYYC SSYTSTSVVF GGGTKLTVL 3806 | EVQLQESGPGLVKPSETLSLTCTVSGGSISNYYWSWIR QPAGKGLGWIGRIYSSGITNYNPSLKSRVTMSVDTSKN QLSLKLSSVTAADTAVYYCAGIVGKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3807 | QSALTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS NNKYAASSYLSLLTPEQWKS HRSYSCQVTHEGSTVEKTV APTECS 3808 |
| 113 | VG9B457 | IgG1 | Lambda | EVQLVESGPGL VKPSETLSLTC TVSGGSISNYY | QAVLTQPASV SGSPGQSITI SCTGTSSDVG | EVQLVESGPGLVKPSETLSLTCTVSGGSISNYYWSWIR QPAGKGLGWIGRIYSSGITNYNPSLKSRVTMSVDTSKN QLSLKLSSVTAADTAVYYCAGIVGKGAFAIWGQGTMV | QAVLTQPASVSGSPGQSIT ISCTGTSSDVGGYNYVSWY QQHPGKAPKLMIYEVSNRP |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | WSWIRQPAGKG LGWIGRIYSSG ITNYNPSLKSR VTMSVDTSKNQ LSLKLSSVTAA DTAVYYCAGIV GVKGAFAIWGQ GTMVTVSS | GYNYVSWYQQ HPGKAPKLMI YEVSNRPSGV SNRFSGSKSG NTASLTISGL QAEDEADYYC SSYTSTSVVF GGGTKLTVL 3840 | TVSSASTKGPSVFPLAPSSKSTSGGTAALGCLVKDYFP EPVTVSWNSGALTSGVHTFPAVLQSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3841 | SGVSNRFSGSKSGNTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS NNKYAASSYLSLTPEQWKS HRSYSCQVTHEGSTVEKTV APTECS 3842 |
| 114 | VG9B442 | IgG1 | Lambda | QVQLVESGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS 3873 | QSALTQPASV SGSPGQSITI SCTGTSSDVG GYNYVSWYQQ HPGKAPKLMI YEVSNRPSGV SNRFSGSKSG NTASLTISGL QAEDEADYYC SSYTSTSVVF GGGTKVTVL 3874 | QVQLVESGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3875 | QSVLTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKVTVLGQPKA APSVTLFPPSSEELQANKA TLVCLISDFYPGAVTVAWK ADSSPVKAGVETTTPSKQS NNKYAASSYLSLTPEQWKS HRSYSCQVTHEGSTVEKTV APTECS 3876 |
| 115 | VG9B436 | IgG1 | Lambda | EVQLVESGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS 3907 | QSVLTQPASV SGSPGQSITI SCTGTSSDVG GYNYVSWYQQ HPGKAPKLMI YEVSNRPSGV SNRFSGSKSG NTASLTISGL QAEDEADYYC SSYTSTSVVF GGGTKLTVL 3908 | EVQLVESGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3909 | QSVLTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS NNKYAASSYLSLTPEQWKS HRSYSCQVTHEGSTVEKTV APTECS 3910 |
| 116 | VG9B434 | IgG1 | Lambda | QVQLQESGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV | QSVLTQPASV SGSPGQSITI SCTGTSSDVG GYNYVSWYQQ HPGKAPKLMI YEVSNRPSGV SNRFSGSKSG NTASLTISGL QAEDEADYYC | QVQLQESGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG | QSVLTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | GVKGAFAIWGQ GTMVTVSS 3941 | SSYTSTSVVF GGGTKLTVL 3942 | QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3943 | NNKYAASSYLSLTPEQWKS HRSYSCQVTHEGSTVEKTV APTECS 3944 |
| 117 | VG9B460 | IgG1 | Lambda | EVQLVESGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS 3975 | QLVLTQPASV SGSPGQSITI SCTGTSSDVG GYNYVSWYQQ HPGKAPKLMI YEVSNRPSGV SNRFSGSKSG NTASLTISGL QAEDEADYYC SSYTSTSVVF GGGTKLTVL 3976 | EVQLVESGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 3977 | QLVLTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS NNKYAASSYLSLTPEQWKS HRSYSCQVTHEGSTVEKTV APTECS 3978 |
| 118 | VG9B189 | IgG1 | Lambda | EVQLVQSGGGL VKPGASLKLSC AASGFTFSNHG MSWVRQTSDKR LEWVASITRGG DTTYYPDNVKG RFTISRENAKN TLYLQMSSLKS DDTALYYCTRG PLTVGYAMDYW GQGTTVTVSS 4009 | QSVVTQPPSA SGSPGQSVTI SCTGTSSDVG GYNYVSWYQQ HPGKAPKLMI YEVSKRPSGV PDRFSGSKSG NTASLTIGSL QAEDEADYYC NSYAGSNNFE VFGGGTKVTV L 4010 | EVQLVQSGGGLVKPGASLKLSCAASGFTFSNHGMSWVR QTSDKRLEWVASITRGGDTTYYPDNVKGRFTISRENAK NTLYLQMSSLKSDDTALYYCTRGPLTVGYAMDYWGQGT TVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK 4011 | QSVVTQPPSASGSPGQSVT ISCTGTSSDVGGYNYVSWY QQHPGKAPKLMIYEVSKRP SGVDRFSGSKSGNTASLT VSGLQAEDEADYYCNSYAG SNNFEVFGGGTKVTVLGQP KAAPSVTLFPPSSEELQAN KATLVCLISDFYPGAVTVA WKADSSPVKAGVETTTPSK QSNNKYAASSYLSLTPEQW KSHRSYSCQVTHEGSTVEK TVAPTECS 4012 |
| 119 | VG9B452 | IgG1 | Lambda | QVQLVESGPGL VKPSETLSLTC TVSGGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS 4043 | QSALTQPASV SGSPGQSITI SCTGTSSDVG GYNYVSWYQQ HPGKAPKLMI YEVSNRPSGV SNRFSGSKSG NTASLTISGL QAEDEADYYC SSYTSTSVVF GGGTKLTVL 4044 | VQLVESGPGLVKPSETLSLTCTVSGGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 4045 | QSALTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS NNKYAASSYLSLTPEQWKS HRSYSCQVTHEGSTVEKTV APTECS 4046 |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| 120 | VG9B53 | IgG1 | Kappa | QVQLQESGPGL VKPSETLSLTC TVSGSISSYY WSWIRQPAGKG LEWIGRIHTIG SINYNPSLKSR VTMSVDTSKNQ FSLKLSSVTAA DTAVYYCAMEG VGATNYYYGMA VWGRGTMVTVS S | DIQMTQSPLS LPVTPGEPAS ISCRSSQSLL HSNGYNYLDW YLQKPGQSPQ LLIYLGSNRA SGVPDRFSGS GSGTDFTLKI SRVEAEDVGV YYCMQALQTP YTFGQGTKVE IK | QVQLQESGPGLVKPSETLSLTCTVSGSISSYYWSWIR QPAGKGLEWIGRIHTIGSINYNPSLKSRVTMSVDTSKN QFSLKLSSVTAADTAVYYCAMEGVGATNYYYGMAVWGR GTMVTVSSASTKGPSVFPLAPSSKSTSGTAALGCLVK DYFPEPVTVSWNSGALTSGVHTFPAVLQSSGLYSLSSV VTVPSSSLGTQTYICNVNHKPSNTKVDKKVEPKSCDKT HTCPPCPAPELLGGPSVFLFPPKPKDTLMISRTPEVTC VVVDVSHEDPEVKFNWYVDGVEVHNAKTKPREEQYNST YRVVSVLTVLHQDWLNGKEYKCKVSNKALPAPIEKTIS KAKGQPREPQVYTLPPSREEMTKNQVSLTCLVKGFYPS DIAVEWESNGQPENNYKTTPPVLDSDGSFFLYSKLTVD KSRWQQGNVFSCSVMHEALHNHYTQKSLSLSPGK 4079 | DIQMTQSPLSLPVTPGEPA SISCRSSQSLLHSNGYNYL DWYLQKPGQSPQLLIYLGS NRASGVPDRFSGSGSGTDF TLKISRVEAEDVGVYYCMQ ALQTPYTFGQGTKVEIKRT VAAPSVFIFPPSDEQLKSG TASVVCLLNNFYPREAKVQ WKVDNALQSGNSQESVTEQ DSKDSTYSLSSTLTLSKAD YEKHKVYACEVTHQGLSSP VTKSFNRGEC 4080 |
| 121 | VG9B41 | IgG1 | Kappa | QVQLQESGPQL VRPGASVKISC KASGYSFTTYW MHWVKQRPGQG LEWIGLIDPSD SETRLNQKFKD KATLTVDKSSS TAYMRLSSPTS EDSAVYYCASN RWLLGWGQGTM VTVSS | EIVLTQTPLS SPVTLQGPAS ISCRSSQSLV HSDGNTYLSW LHQRPGQPPR LLIYKISNRF SGVPDRFSGS GAGTDFTLKI SRVETEDVGV YYCVQTREFP LTFGGGTKVE IK | QVQLQESGPQLVRPGASVKISCKASGYSFTTYWMHWVK QRPGQGLEWIGLIDPSDSETRLNQKFKDKATLTVDKSS STAYMRLSSPTSEDSAVYYCASNRWLLGWGQGTMVTVS SASTKGPSVFPLAPSSKSTSGTAALGCLVKDYFPEPV TVSWNSGALTSGVHTFPAVLQSSGLYSLSSVVTVPSSS LGTQTYICNVNHKPSNTKVDKKVEPKSCDKTHTCPPCP APELLGGPSVFLFPPKPKDTLMISRTPEVTCVVVDVSH EDPEVKFNWYVDGVEVHNAKTKPREEQYNSTYRVVSVL TVLHQDWLNGKEYKCKVSNKALPAPIEKTISKAKGQPR EPQVYTLPPSREEMTKNQVSLTCLVKGFYPSDIAVEWE SNGQPENNYKTTPPVLDSDGSFFLYSKLTVDKSRWQQG NVFSCSVMHEALHNHYTQKSLSLSPGK 4113 | EIVLTQTPLSSPVTLQGPA SISCRSSQSLVHSDGNTYL SWLHQRPGQPPRLLIYKIS NRFSGVPDRFSGSGAGTDF TLKISRVETEDVGVYYCVQ TREFPLITFGGGTKVEIKRT VAAPSVFIFPPSDEQLKSG TASVVCLLNNFYPREAKVQ WKVDNALQSGNSQESVTEQ DSKDSTYSLSSTLTLSKAD YEKHKVYACEVTHQGLSSP VTKSFNRGEC 4114 |
| 122 | VG9B136 | IgG1 | Kappa | QVQLQQSGPGL VKPSQTLSLTC AISGDSVSSNR AAWNWIRQSPS KGLEWLGRTYY RSKWNEYAAS VKSRMSINPDT SKNQFSLQLNS VTPEDTALYYC ARDIWELREAC DIWGQGTMVTV SS | DIVMTQSPSF LSTFVGDRVT ITCRASQGIS SYLAWYQQKP GKVPKLLIYV ASTLQSGVPS RFSGSGSGTE FTLTISSLQP EDFATYYCQQ LNSYPTFGP GTKVDIK | QVQLQQSGPGLVKPSQTLSLTCAISGDSVSSNRAAWNW IRQSPSKGLEWLGRTYYRSKWNEYAASVKSRMSINPD TSKNQFSLQLNSVTPEDTALYYCARDIWELREACDIWG QGTMVTVSSASTKGPSVFPLAPSSKSTSGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 4147 | DIVMTQSPSFLSTFVGDRV TITCRASQGISSYLAWYQQ KPGKVPKLLIYVASTLQSG VPSRFSGSGSGTEFTLTIS SLQPEDFATYYCQQLNSYP FTFGPGTKVDIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 4148 |
| 123 | VG9B399 | IgG1 | Kappa | EVQLVESGGGL VKPGGSLRLSC SASGFTFSNYD MNWVRQAPGKG LEWVSSISSSS | ETTLTQSPGT LSLSPGDRAT LSCRASQSVA SSYLAWYQQK PGQSPRLLIY | EVQLVESGGGLVKPGGSLRLSCSASGFTFSNYDMNWVR QAPGKGLEWVSSISSSSIYYADSVKGRFTISRDNAK NSLYLQMNSLRAEDTAVYHCARDVGVTTDYYYGMDVW GQGTMVTVSSASTKGPSVFPLAPSSKSTSGTAALGCL VKDYFPEPVTVSWNSGALTSGVHTFPAVLQSSGLYSLS | ETTLTQSPGTLSLSPGDRA TLSCRASQSVASSYLAWYQ QKPGQSPRLLIYGASSRAT GIPDRFSGSGSGTDFTLTI SRLEPEDFAVYYCQQYGSS |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| 124 | VG9B369 | IgG1 | Kappa | EVQLVESGPTL VKPTQTLTLTC TFSGFSLSTIG VGVGWIRQPPG KALEWLSLIYW NDDKRYNPSLK SRLTITKDTSK NQVLTMTNMD PVDTATYYCAH SHDWVHAFDIW GQGTMVTVSS | DIVMTQSPSS LSASVGDRVT ITCQASQDIS HYLNWYQQKP GKAPKFLIYD ASNLDTGVPS RFSGSGSGTD FTFTISSLQP EDIATYYCQQ YDNFPLTFGG GTKVEIK | EVQLLESGPTLVKPTQTLTLTCTFSGFSLSTIGVGVGW IRQPPGKALEWLSLIYWNDDKRYNPSLKSRLTITKDTS KNQVVLTMTNMDPVDTATYYCAHSHDWVHAFDIWGQGT MVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTHT CPPCPAPELLGGPSVFLFPPKPKDTLMISRTPEVTCVV VVDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPGK | DIVMTQSPSSLSASVGDRV TITCQASQDISHYLNWYQQ KPGKAPKFLIYDASNLDTG VPSRFSGSGSGTDFTFTIS SLQPEDIATYYCQQYDNFP LTFGGGTKVEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC |
|   |   |   |   | 4179 | 4180 | 4181 | 4182 |
| 125 | VG9B144 | IgG1 | Lambda | QVQLVQSGAEV KKPGASVKVSC KASGYTFTGYY MHWMRQAPGQG LEWMGWINPNS GATNKEQKFQG RVTMTRDTSIS TAYMELSRLRS DDTAVYYCARE DDAFDWGQGT MVTVSS | SSELTQDPAV SVALGQTVRI TCQGDNLRNY YATWFQQKPG QAPVLVFFGK NNRPSGIPDR FSGSSSGDTA SLTITGAQAE DEADYCNSRD SSGNHVVFG GGTKLTVL | QVQLVQSGAEVKKPGASVKVSCKASGYTFTGYYMHWMR QAPGQGLEWMGWINPNSGATNKEQKFQGRVTMTRDTSI STAYMELSRLRSDDTAVYYCAREDDAFDWGQGTMVTV SSASTKGPSVFPLAPSSKSTSGGTAALGCLVKDYFPEP VTVSWNSGALTSGVHTFPAVLQSSGLYSLSSVVTVPSS SLGTQTYICNVNHKPSNTKVDKKVEPKSCDKTHTCPPC PAPELLGGPSVFLFPPKPKDTLMISRTPEVTCVVVDVS HEDPEVKFNWYVDGVEVHNAKTKPREEQYNSTYRVVSV LTVLHQDWLNGKEYKCKVSNKALPAPIEKTISKAKGQP REPQVYTLPPSREEMTKNQVSLTCLVKGFYPSDIAVEW ESNGQPENNYKTTPPVLDSDGSFFLYSKLTVDKSRWQQ GNVFSCSVMHEALHNHYTQKSLSLSPGK | SSELTQDPAVSVALGQTVR ITCQGDNLRNYYATWFQQK PGQAPVLVFFGKNNRPSGI PDRFSGSSSGDTASLTITG AQAEDEADYCNSRDSSGN HVVFGGGTKLTVLGQPKAA PSVTLFPPSSEELQANKAT LVCLISDFYPGAVTVAWKA DSSPVKAGVETTTPSKQSN NKYAASSYLSLTPEQWKSH RSYSCQVTHEGSTVEKTVA PTECS |
|   |   |   |   | 4247 | 4248 | 4249 | 4250 |
| 126 | VG9B410 | IgG1 | Kappa | EVQLVESGGGL VKPGGSLRLSC AASGFTFSNYG MNWVRQAPGKG LEWVSYISSGS SYKYADSMKG RFTISRDNAMN LLYLQMNSLRP EDSAMYYCARD PVVTEYYYGM DVWGQGTTVTV VSS | DIQMTQSPSS VSASVGDRVT ITCRASQGIN SWLAWYQQKP GNAPKLLIYA ASSLQSGVPS RFSGIGSGTD FIFTISSLQP EDFASYYCQQ ANSFPWTFGQ GTKVEIK | EVQLVESGGGLVKPGGSLRLSCAASGFTFSNYGMNWVR QAPGKGLEWVSYISSGSSYKYYADSMKGRFTISRDNAM NLLYLQMNSLRPEDSAMYYCARDPVVTEYYYGMDVWG QGTTVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV | DIQMTQSPSSVSASVGDRV TITCRASQGINSWLAWYQQ KPGNAPKLLIYAASSLQSG VPSRFSGIGSGTDFIFTIS SLQPEDFASYYCQQANSFP WTFGGGTKVEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| 127 | VG9B386 | IgG1 | Kappa | EVQLVESGGGL VKPGGSLRLSC AASGFTFSSYS MIWVRQAPGKG LEWVSSIGSSS TYIYYADSVRG RFTISRDNAKT SLYLQMNSLRA EDTAMYFCARD GETGGFDVWGQ GILVTVSS 4281 | EIVMTQSPGT LSLSPGERAT LSCRASQSIS RSYLAWYQQK PGQPPRLLIY GPSNRATGIP DRFSASGSGT DFTLTNSRLE PEDFAVYYCQ QYGSLPLTFG GGTKVEIK 4282 | DKSRWQQGNVFSCSVMHEALHNHYTQKSLSLSPGK 4283 | NRGEC 4284 |
| | | | | | | EVQLVESGGGLVKPGGSLRLSCAASGFTFSSYSMIWVR QAPGKGLEWVSSIGSSSTYIYYADSVRGRFTISRDNAK TSLYLQMNSLRAEDTAMYFCARDGETGGFDVWGQGILV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK | EIVMTQSPGTLSLSPGERA TLSCRASQSISRSYLAWYQ QKPGQPPRLLIYGPSNRAT GIPDRFSASGSGTDFTLTN SRLEPEDFAVYYCQQYGSL PLTFGGGTKVEIKRTVAAP SVFIFPPSDEQLKSGTASV VCLLNNFYPREAKVQWKVD NALQSGNSQESVTEQDSKD STYSLSSTLTLSKADYEKH KVYACEVTHQGLSSPVTKS FNRGEC |
| 128 | VG9B125 | IgG1 | Kappa | EVQLVESGGTL VQPGGSLRLSC AVSGFTFSSYD MNWVRQAPGKG LEWVSYISSSS TAKYYADSVKG RFTISRDNAKN SLYLQMNSLWD EDTAVYYCARE DIVVTPILQH WGQGTTVTVSS 4315 | EIVMTQSPAT LSLSPGERAI LSCRASQSVS KDLAWYQQKP GQAPRLLIYD ASNRATGIPA RISGSGSGTD FTLTISSLEP EDFAVYYCQQ RINWPLFTFG PGTKVEIK 4316 | EVQLVESGGTLVQPGGSLRLSCAVSGFTFSSYDMNWVR QAPGKGLEWVSYISSSSTAKYYADSVKGRFTISRDNAK NSLYLQMNSLWDEDTAVYYCAREDIVVVTPILQHWGQG TTVTVSSASTKGPSVFPLAPSSKSTSGGTAALGCLVKD YFPEPVTVSWNSGALTSGVHTFPAVLQSSGLYSLSSVV TVPSSSLGTQTYICNVNHKPSNTKVDKKVEPKSCDKTH TCPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMKNQVSLTCLVKGFYPSD IAVEWESNGQPENNYKTTPPVLDSDGSFFLYSKLTVDK SRWQQGNVFSCSVMHEALHNHYTQKSLSLSPGK 4351 | EIVMTQSPATLSLSPGERA ILSCRASQSVSKDLAWYQQ KPGQAPRLLIYDASNRATG IPARISGSGSGTDFTLTIS SLEPEDFAVYYCQQRINWP LFTFGPGTKVEIKRTVAAP SVFIFPPSDEQLKSGTASV VCLLNNFYPREAKVQWKVD NALQSGNSQESVTEQDSKD STYSLSSTLTLSKADYEKH KVYACEVTHQGLSSPVTKS FNRGEC 4352 |
| 129 | VG9B112 | IgG1 | Kappa | QVQLQQSGPGL VKPSQTLSLTC AISGDSVSSNS AAWNWIRQSPS RGLEWLGGTYY RSKWFNNYAVS VKSRITINPDT STNQFSLQLNS VTPADTAVYYC ARGEWGLRDAF DIWGQGTMVTV SS 4383 | DIQMTQSPSF LSASVGDRVI ITCRASQGIH SYLAWYQQKP GKVPKLLIYV ASTLQSGVPS RFSGSGSGTE FTLTISSLQP EDFATYYCQQ LNSYPWTFGQ GTKLEIK 4384 | QVQLQQSGPGLVKPSQTLSLTCAISGDSVSSNSAAWNW IRQSPSRGLEWLGGTYYRSKWFNNYAVSVKSRITINPD TSTNQFSLQLNSVTPADTAVYYCARGEWGLRDAFDIWG QGTMVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 4385 | DIQMTQSPSFLSASVGDRV IITCRASQGIHSYLAWYQQ KPGKVPKLLIYVASTLQSG VPSRFSGSGSGTEFTLTIS SLQPEDFATYYCQQLNSYP WTFGQGTKLEIKRTVAAPS VFIFPPSDEQLKSGTASVV CLLNNFYPREAKVQWKVDN ALQSGNSQESVTEQDSKDS TYSLSSTLTLSKADYEKHK VYACEVTHQGLSSPVTKSF NRGEC 4386 |
| 130 | VG9B371 | IgG1 | Kappa | EVQLLESGGGL VKPGGSLRLSC AASRFTLSSYD | EIVMTQSPGT LSLSPGERAT LSCRASQSVS | EVQLLESGGGLVKPGGSLRLSCAASRFTLSSYDMNWVR QAPGKGLEWVSISSSSYIYYADSVKGRFTISRDNAK NSLYLQMNSLRAEDTAVYYCARDRGVGGTDYYYGLDV | EIVMTQSPGTLSLSPGERA TLSCRASQSVSSSYLAWYQ QKPGQAPRLLIYGASSRAT |

TABLE 2-continued

VH and VL Amino Acid Sequences

| # | Protein Name | HC Isotype | LC Isotype | VH AA sequence | VL AA sequence | Heavy Chain AA sequence | Light Chain AA sequence |
|---|---|---|---|---|---|---|---|
| 131 | VG9B387 | IgG1 | Lambda | MNWVRQAPGKG LEWVSISSSS SYIYADSVKG RFTISRDNAKN SLYLQMNSLRA EDTAVYYCARD RGVGGTDYYY GLDVWGQGTTV TVSS 4417 | SSYLAWYQQK PGQAPRLLIY GASSRATGIP DRFSGSGSGT DFTLTISRLE PEDFAVYYCQ QYGSSPPYTF GQGTKVEIK 4418 | WGQGTTVTVSSASTKGPSVFPLAPSSKSTSGGTAALGC LVKDYFPEPVTVSWNSGALTSGVHTFPAVLQSSGLYSL SSVVTVPSSSLGTQTYICNVNHKPSNTKVDKKVEPKSC DKTHTCPPCPAPELLGGPSVFLFPPKPKDTLMISRTPE VTCVVVDVSHEDPEVKFNWYVDGVEVHNAKTKPREEQY NSTYRVVSVLTVLHQDWLNGKEYKCKVSNKALPAPIEK TISKAKGQPREPQVYTLPPSREEMTKNQVSLTCLVKGF YPSDIAVEWESNGQPENNYKTTPPVLDSDGSFFLYSKL TVDKSRWQQGNVFSCSVMHEALHNHYTQKSLSLSPGK 4419 | GIPDRFSGSGSGTDFTLTI SRLEPEDFAVYYCQQYGSS PPYTFGQGTKVEIKRTVAA PSVFIFPPSDEQLKSGTAS VVCLLNNFYPREAKVQWKV DNALQSGNSQESVTEQDSK DSTYSLSSTLTLSKADYEK HKVYACEVTHQGLSSPVTK SFNRGEC 4420 |
| 132 | VG9B47 | IgG1 | Kappa | EVQLVESGAEV KKPGASVKVSC KASGFTFTGYY LQWVRQAPGQG LEWMGWINPNS GYTDYAQRFQD RVTMTRDTSIN TAYMELSRLRS DDTAVYYCARL DDAFDVWGQGT MVTVSS 4451 | SYELTQDPAV SVALGQTVRI TCQGDSLRNY YAIWYQQKPG QAPVLVIFGK NNRPSGIPDR FSGSSSGTTA SLTITGQAEP DEADYYCNSR DSSGNHWVFG GGTKLTVL 4452 | EVQLVESGAEVKKPGASVKVSCKASGFTFTGYYLQWVR QAPGQGLEWMGWINPNSGYTDYAQRFQDRVTMTRDTSI NTAYMELSRLRSDDTAVYYCARLDDAFDVWGQGTMVTV SSASTKGPSVFPLAPSSKSTSGGTAALGCLVKDYFPEP VTVSWNSGALTSGVHTFPAVLQSSGLYSLSSVVTVPSS SLGTQTYICNVNHKPSNTKVDKKVEPKSCDKTHTCPPC PAPELLGGPSVFLFPPKPKDTLMISRTPEVTCVVVDVS HEDPEVKFNWYVDGVEVHNAKTKPREEQYNSTYRVVSV LTVLHQDWLNGKEYKCKVSNKALPAPIEKTISKAKGQP REPQVYTLPPSREEMTKNQVSLTCLVKGFYPSDIAVEW ESNGQPENNYKTTPPVLDSDGSFFLYSKLTVDKSRWQQ GNVFSCSVMHEALHNHYTQKSLSLSPGK 4453 | SYELTQDPAVSVALGQTVR ITCQGDSLRNYYAIWYQQK PGQAPVLVIFGKNNRPSGI PDRFSGSSSGTTASLTITG TQAEDEADYYCNSRDSSGN HWVFGGGTKLTVLGQPKAA PSVTLFPPSSEELQANKAT LVCLISDFYPGAVTVAWKA DSSPVKAGVETTTPSKQSN NKYAASSYLSLTPEQWKSH RSYSCQVTHEGSTVEKTVA PTECS 4454 |
| 132 | VG9B47 | IgG1 | Kappa | QVQLVQSGAEV KKPGSSVKVSC KASGGSFSNYA ISWMRQAPGQG LEWMGGIIPFF GTPDYAQKFQG RVTITADKSTS TAYMELSSLRS EDTAVYYCSTG GGYGDYDYYG INVWGQGTMVT VSS 4485 | DIVMTQSPLS SPVDLGQPAS ISCRSSQSLV HSDGNTYLSW LQQRPGQPPR LLIYKISNRF SGVPDRFSGS GAGTDFTLKI SRVEAEDVGV YYCMQAEFP LTLGGGTKVD IK 4486 | QVQLVQSGAEVKKPGSSVKVSCKASGGSFSNYAISWMR QAPGQGLEWMGGIIPFFGTPDYAQKFQGRVTITADKST STAYMELSSLRSEDTAVYYCSTGGYGDYDYYGINVW GQGTMVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKKVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPGK 4487 | DIVMTQSPLSSPVDLGQPA SISCRSSQSLVHSDGNTYL SWLQQRPGQPPRLLIYKIS NRFSGVPDRFSGSGAGTDF TLKISRVEAEDVGVYYCMQ AKEFPLTLGGGTKVDIKRT VAAPSVFIFPPSDEQLKSG TASVVCLLNNFYPREAKVQ WKVDNALQSGNSQESVTEQ DSKDSTYSLSSTLTLSKAD YEKHKVYACEVTHQGLSSP VTKSFNRGEC 4488 |
| 133 | VG9B379 | IgG1 | Lambda | EVQLVQSGPEV KKPGASVKVSC KASGYTFTGDY IHWVRQPGQG LEWMGWINPNS GGTNYAQKFQG RVTMRDTSIS TAFMELSRLRS DDTAVYYCARE | SSELTQDPAV SVALGQTVRI TCQGDSLRSY YARWYQQKPG QAPVVVIYGK NNRPSGIPDR FSGSSSGNTA SLTITGAQAE DEADYYCNSR | EVQLVQSGPEVKKPGASVKVSCKASGYTFTGDYIHVR QVPGQGLEWMGWINPNSGGTNYAQKFQGRVTMTRDTSI STAFMELSRLRSDDTAVYYCAREGGVAPAAPDAFDIWG QGTMVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI | SSELTQDPAVSVALGQTVR ITCQGDSLRSYYARWYQQK PGQAPVVVIYGKNNRPSGI PDRFSGSSSGNTASLTITG AQAEDEADYYCNSRDSSGN HRVFGGGTKLTVLGQPKAA PSVTLFPPSSEELQANKAT LVCLISDFYPGAVTVAWKA DSSPVKAGVETTTPSKQSN |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| | | | | GGVAPAAPDAF DIWGQGTMVTV SS 4519 | DSSGNHRVFG GGTKLTVL 4520 | SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 4521 | NKYAASSYLSLTPEQWKSH RSYSCQVTHEGSTVEKTVA PTECS 4522 |
| 134 | VG9B447 | IgG1 | Lambda | QVQLQESGPGL VKPSETLSLTC TVSGSISNYY WSWIRQPAGKG LGWIGRIYSSG ITNYNPSLKSR VTMSVDTSKNQ LSLKLSSVTAA DTAVYYCAGIV GVKGAFAIWGQ GTMVTVSS 4553 | SYELTQPASV SGSPGQSITI SCTGTSSDVG GYNYVSWYQQ HPGKAPKLMI YEVSNRPSGV SNRFSGSKSG NTASLLTISGL QAEDEADYYC SSYTSTSVVF GGGTKLTVL 4554 | QVQLQESGPGLVKPSETLSLTCTVSGSISNYYWSWIR QPAGKGLGWIGRIYSSGITNYNPSLKSRVTMSVDTSKN QLSLKLSSVTAADTAVYYCAGIVGVKGAFAIWGQGTMV TVSSASTKGPSVFPLAPSSKSTSGGTAALGCLVKDYFP EPVTVSWNSGALTSGVHTFPAVLQSSGLYSLSSVVTVP SSSLGTQTYICNVNHKPSNTKVDKKVEPKSCDKTHTCP PCPAPELLGGPSVFLFPPKPKDTLMISRTPEVTCVVVD VSHEDPEVKFNWYVDGVEVHNAKTKPREEQYNSTYRVV SVLTVLHQDWLNGKEYKCKVSNKALPAPIEKTISKAKG QPREPQVYTLPPSREEMTKNQVSLTCLVKGFYPSDIAV EWESNGQPENNYKTTPPVLDSDGSFFLYSKLTVDKSRW QQGNVFSCSVMHEALHNHYTQKSLSLSPGK 4555 | SYELTQPASVSGSPGQSIT ISCTGTSSDVGGYNYVSWY QQHPGKAPKLMIYEVSNRP SGVSNRFSGSKSGNTASLT ISGLQAEDEADYYCSSYTS TSVVFGGGTKLTVLGQPKA APSVTLFPPSSEELQANKA TLVCLISDFYPGAVTVAWK ADSSPVKAGVETTTPSKQS NNKYAASSYLSLTPEQWKS HRSYSCQVTHEGSTVEKTV APTECS 4556 |
| 135 | VG9B392 | IgG1 | Lambda | QVQLVQSGAEV KRPGASAKVSC KTSGYTFTGY IHWVRQAPGQG LEWMGWINPNS GYTNSAQKFQG RVSMRDTSIS TVYMELSRLRS DDTAVYYCARE DDAFDIWGQGT LVTVSS 4587 | SSELTQDPAV SVALGQTVRI TCQGDSLRSY YARWYQQKPG QAPVLVIYGK NNRPSGIPDR FSGSSSGDTA SLTITGALAE DEADYYCNSR DNSGNHVVFG GGTKVTVL 4588 | QVQLVQSGAEVKRPGASAKVSCKTSGYTFTGYIHWVR QAPGQGLEWMGWINPNSGYTNSAQKFQGRVSMRDTSI STVYMELSRLRSDDTAVYYCAREDDAFDIWGQGTLVTV SSASTKGPSVFPLAPSSKSTSGGTAALGCLVKDYFPEP VTVSWNSGALTSGVHTFPAVLQSSGLYSLSSVVTVPSS SLGTQTYICNVNHKPSNTKVDKKVEPKSCDKTHTCPPC PAPELLGGPSVFLFPPKPKDTLMISRTPEVTCVVVDVS HEDPEVKFNWYVDGVEVHNAKTKPREEQYNSTYRVSV LTVLHQDWLNGKEYKCKVSNKALPAPIEKTISKAKGQP REPQVYTLPPSREEMTKNQVSLTCLVKGFYPSDIAVEW ESNGQPENNYKTTPPVLDSDGSFFLYSKLTVDKSRWQQ GNVFSCSVMHEALHNHYTQKSLSLSPGK 4589 | SSELTQDPAVSVALGQTVR ITCQGDSLRSYYARWYQQK PGQAPVLVIYGKNNRPSGI PDRFSGSSSGDTASLTITG ALAEDEADYYCNSRDNSGN HVVFGGGTKVTVLGQPKAA PSVTLFPPSSEELQANKAT LVCLISDFYPGAVTVAWKA DSSPVKAGVETTTPSKQSN NKYAASSYLSLTPEQWKSH RSYSCQVTHEGSTVEKTVA PTECS 4590 |
| 136 | VG9B96 | IgG1 | Kappa | EVQLVQSGAEV KKPGSSVKVSC KASGGTFSNYA ISWVRLAPGQG LEWMGGIIPIF SAGTYAQRFQG RVTITADKSTS TAYMELNSLRS EDTAVYYCSSN SGTYDYYGM DVWGQGTMVTV SS 4621 | DIVMTQSPLS SHVTLGQPAS ISCRSSQSLV HSDGNTYLSW LQQRPGQPPR LLIYKIFNRL SGVPDRFSGS GAGTDFTLKI SRVEAEDVGV YYCMQAKQFP LTFGGGTKVE IK 4622 | EVQLVQSGAEVKKPGSSVKVSCKASGGTFSNYAISWVR LAPGQGLEWMGGIIPIFSAGTYAQRFQGRVTITADKST STAYMELNSLRSEDTAVYYCSSNSGTYDYYGMDVWG QGTMVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKKVEPKSCDK THTCPPCPAPELLGGPSVFLFPPKPKDTLMISRTPEVT CVVVDVSHEDPEVKFNWYVDGVEVHNAKTKPREEQYNS TYRVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPGK 4623 | DIVMTQSPLSSHVTLGQPA SISCRSSQSLVHSDGNTYL SWLQQRPGQPPRLLIYKIF NRLSGVPDRFSGSGAGTDF TLKISRVEAEDVGVYYCMQ AKQFPLTFGGGTKVEIKRT VAAPSVFIFPPSDEQLKSG TASVVCLLNNFYPREAKVQ WKVDNALQSGNSQESVTEQ DSKDSTYSLSSTLTLSKAD YEKHKVYACEVTHQGLSSP VTKSFNRGEC 4624 |

TABLE 2-continued

VH and VL Amino Acid sequences

| # | Protein Name | HC Isotype | LC Isotype | VH AA sequence | VL AA sequence | Heavy Chain AA sequence | Light Chain AA sequence |
|---|---|---|---|---|---|---|---|
| 137 | VG9B77 | IgG1 | Kappa | EVQLVESGAEVMKPGSSVKVSCKASGTFSSYAISWVRQAPEQGLEWMGGIIPFFGTADYAQKFQGRVTITADKSTNTAYMELTSLRSEDTAVYYCATATVTTDYYYGMDVWGQGTMVTVSS 4655 | EIVMTQSPLFSPVTLGQPASISCRSSQSLVHSDGNTYLSWLQQRPGQPPRLLIYEISNRFTGVPDRFSGSGAGTDFTLKISRVEAEDVGVYYCMQARQFPLTFGGGTKVEIK 4656 | EVQLVESGAEVMKPGSSVKVSCKASGTFSSYAISWVRQAPEQGLEWMGGIIPFFGTADYAQKFQGRVTITADKSTNTAYMELTSLRSEDTAVYYCATATVTTDYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK 4657 | EIVMTQSPLFSPVTLGQPASISCRSSQSLVHSDGNTYLSWLQQRPGQPPRLLIYEISNRFTGVPDRFSGSGAGTDFTLKISRVEAEDVGVYYCMQARQFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC 4658 |

TABLE 3

Kabat CDR Amino Acid Sequences

| # | Protein Name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|---|
| 1 | VG9B54 | SYSLT 1 | SISSSSSYIFYADSVKG 2 | DGELGPFDY 3 | RASQSVSSSYLA 4 | GASSRAT 5 | QQYGRSPLT 6 |
| 2 | VG9B121 | DYAMD 35 | SISSTSNYIFYADSVKG 36 | SYNWNYGGAFDI 37 | RASQSVSSSYFA 38 | GASSRAT 39 | QQYGRSPLT 40 |
| 3 | VG9B429 | NYDMN 69 | SISSSSSYIYYADSVKG 70 | DVGVTTDYYYYGMDV 71 | RASQGINSWLA 72 | AASSLQS 73 | QQANSFPWT 74 |
| 4 | VG9B370 | SYDMN 103 | SISSSSSYIYYADSVKG 104 | DRGVGGTDYYYYGLDV 105 | RASQSVSSSYLA 106 | GASSRAT 107 | QQYGSSPPYT 108 |
| 5 | VG9B80 | TYSMN 137 | SISSSSSYIFYADSVKG 138 | DGELGVFDY 139 | RASQSISSSYLA 140 | GPSGRAT 141 | QQFGRSPLT 142 |
| 6 | VG9B414 | NYDMN 171 | SISSSSSYIYYADSVKG 172 | DVGVTTDYYYYGMDV 173 | RASQGINSWLA 174 | AASSLQS 175 | QQANSFPWT 176 |
| 7 | VG9B195 | PYTMN 205 | SISSSSSYMYYADSVKG 206 | DGDLVGPTYYFDY 207 | SGDKLGDKYAC 208 | QHNKRPS 209 | QAWDSTTVV 210 |
| 8 | VG9B140 | SYDMN 239 | SISTSSGYIYYADSVKG 240 | DRGIAVAGDYYYGMDV 241 | RASQSVSSSYLA 242 | GASSRAT 243 | QQYGSSPPYT 244 |
| 9 | VG9B426 | NYDMN 273 | SISSSSSYIYYADSVKG 274 | DVGVTTDYYYYGMDV 275 | RASQSVASSYLA 276 | GASSRAT 277 | QQYGSSPPYT 278 |
| 10 | VG9B46 | INSMN 307 | SISSTSDYIFNADSVKG 308 | DDVFGAFDI 309 | RTSQSVSRSYLG 310 | GSSSRAT 311 | QQYSRSPLT 312 |
| 11 | VG9B416 | NYDMN 341 | SISSSSSYIYYADSVKG 342 | DVGVTTDYYYYGMDV 343 | RASQSVASSYLA 344 | GASSRAT 345 | QQYGSSPPYT 346 |
| 12 | VG9B69 | SYDIN 375 | SITSSSYYIYYADSVKG 376 | DLGVRGVDYYYYGLDV 377 | RASQSVSSSYLA 378 | GASSRAT 379 | QQYGSSPPYT 380 |
| 13 | VG9B415 | NYDMN 409 | SISSSSSYIYYADSVKG 410 | DVGVTTDYYYYGMDV 411 | RASQSVASSYLA 412 | GASSRAT 413 | QQYGSSPPYT 414 |
| 14 | VG9B104 | VYSMN 443 | SIGSSSSYIFYADSVKG 444 | DHDYGGLDY 445 | RASQSVSSSYLA 446 | GPSNRAT 447 | QQYGRSPLT 448 |
| 15 | VG9B198 | SIYWS 477 | RIYTTDITNYNPSLKS 478 | NGYSYGGFNY 479 | TGSSSNIGAGYDVH 480 | GDSYRPS 481 | QSYDSSLSVVV 482 |
| 16 | VG9B463 | NYDMN 511 | SISSSSSYIYYADSVKG 512 | DVGVTTDYYYYGMDV 513 | SGSSSNIGSNTVN 514 | TNTQRPS 515 | AAWDDSLNAWV 516 |
| 17 | VG9B469 | HYDMN 545 | SISSSSSYIFYADSVKG 546 | DRGVGDTSDYYSFGLDV 547 | RASQNVSSTYLA 548 | GACSRAT 549 | QQYGSSPPYT 550 |
| 18 | VG9B428 | NYGMN 579 | YISSGSSYKYYADSMKG 580 | DPVVTEYYYYGMDV 581 | RASQGINSWLA 582 | AASSLQS 583 | QQANSFPWT 584 |
| 19 | VG9B430 | SYDMN 613 | SISSSSSYIYYADSVKG 614 | DVGVTTDYYYYGMDV 615 | RASQSVASSYLA 616 | GASSRAT 617 | QQYGSSPPYT 618 |
| 20 | VG9B423 | NYDMN 647 | SISSSSSYIYYADSVKG 648 | DVGVTTDYYYYGMDV 649 | RASQSVASSYLA 650 | GASSRAT 651 | QQYGSSPPYT 652 |
| 21 | VG9B98 | SYSMY 681 | SIGSSSTYIFYADSVKG 682 | DGELGPFEY 683 | RASQSVSTSYLA 684 | GTSSRAT 685 | LQYGRSPLT 686 |
| 22 | VG9B73 | NYDMN 715 | SISSSSSYIYYADSVKG 716 | EIGVTGTTYYQDYGMDV 717 | RASQSFSSNYLA 718 | GASSRAT 719 | QQYGSSPPFT 720 |
| 23 | VG9B133 | NYDMN 749 | SISSSSSYIYYADSVKG 750 | DLGITGTTMDYYYGMDV 751 | RASQSVSSSYLA 752 | GASSRAT 753 | QQYGSSPPYT 754 |
| 24 | VG9B368 | SYDMN 783 | SISSSSSYIYYADSVKG 784 | DRGIGGDYYSYAMDV 785 | RASQSVSSSYLA 786 | GASSRAT 787 | QQYGSSPPYT 788 |
| 25 | VG9B424 | NYDMN 817 | SISSSSSYIYYADSVKG 818 | DVGVTTDYYYYGMDV 819 | RASQSVASSYLA 820 | GASSRAT 821 | QQYGSSPPYT 822 |

TABLE 3-continued

Kabat CDR Amino Acid Sequences

| # | Protein Name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|---|
| 26 | VG9B427 | NYDMN 851 | SISSSSYIYYADSVKG 852 | DVGVTTDYYYYGMDV 853 | RASQSVASSYLA 854 | GASSRAT 855 | QQYGSSPPYT 856 |
| 27 | VG9B417 | NYGMN 885 | YISSGSSYKYYADSMKG 886 | DPVVTEYYYYGMDV 887 | RASQGINSWLA 888 | AASSLQS 889 | QQANSFPWT 890 |
| 28 | VG9B58 | SSYWT 919 | YMFYLGSTNYNPSLKS 920 | ERPVLDAFDI 921 | RASQDITNYLA 922 | AASSLQG 923 | LQHDTYPYT 924 |
| 29 | VG9B419 | NYDMN 953 | SISSSSYIYYADSVKG 954 | DVGVTTDYYYYGMDV 955 | RASQSVASSYLA 956 | GASSRAT 957 | QQYGSSPPYT 958 |
| 30 | VG9B425 | NYDMN 987 | SISSSSYIYYADSVKG 988 | DVGVTTDYYYYGMDV 989 | RASQSVASSYLA 990 | GASSRAT 991 | QQYGSSPPYT 992 |
| 31 | VG9B143 | TYGMN 1021 | YISTSSYTIYYSDSVKG 1022 | EGDWWYFDL 1023 | TGTSSDVGGYNYVS 1024 | EVSNRPS 1025 | SSYTSSSTLV 1026 |
| 32 | VG9B418 | NYDMN 1055 | SISSSSYIYYADSVKG 1056 | DVGVTTDYYYYGMDV 1057 | RASQSVASSYLA 1058 | GASSRAT 1059 | QQYGSSPPYT 1060 |
| 33 | VG9B472 | HYDMN 1089 | SISSSSYIFYADSVKG 1090 | DRGVGDTSDYYSFGLDV 1091 | RASQGIATYLA 1092 | AASTLQS 1093 | QKYNSAPPWT 1094 |
| 34 | VG9B421 | NYGMN 1123 | YISSGSSYKYYADSMKG 1124 | DPVVTEYYYYGMDV 1125 | RASQGINSWLA 1126 | AASSLQS 1127 | QQANSFPWT 1128 |
| 35 | VG9B88 | SYTMN 1157 | SISTSSSYIDYADSVKG 1158 | DGDMVAPIKGSFDY 1159 | RSSQSLLNSDDGNTYLD 1160 | TLSYRAS 1161 | MQRIEFPIT 1162 |
| 36 | VG9B384 | SSGMCVS 1191 | LIDWFDDKYYSTSLKT 1192 | IRGTGAYYYGLDV 1193 | SGNELGDKYAS 1194 | QDNKRPS 1195 | QAWDSSKVV 1196 |
| 37 | VG9B413 | NYDMN 1225 | SISSSSYIYYADSVKG 1226 | DVGVTTDYYYYGMDV 1227 | RASQSVASSYLA 1228 | GASSRAT 1229 | QQYGSSPPYT 1230 |
| 38 | VG9B36 | SYGMY 1259 | SISTGSSYIYYADSVKG 1260 | DKGLAVTGYIMDV 1261 | QASQDISNYLN 1262 | DASNLET 1263 | QQYDNLPMYT 1264 |
| 39 | VG9B403 | NYDMN 1293 | SISSSSYIYYADSVKG 1294 | DVGVTTDYYYYGMDV 1295 | RASQSVASSYLA 1296 | GASSRAT 1297 | QQYGSSPPYT 1298 |
| 40 | VG9B191 | RYSMN 1327 | SISSSSYIYYADSVKG 1328 | DGPTVNWDYYFDL 1329 | SGSSSNIGNNYVS 1330 | DNNKRPS 1331 | GTWDSSLSTSVV 1332 |
| 41 | VG9B44 | SNSAAWN 1361 | RTYYRSKWYNDYPISVKS 1362 | ESGSYYTDGFDI 1363 | RASQGISSYLA 1364 | AASTLQS 1365 | QEFNSYPYT 1366 |
| 42 | VG9B67 | SYTMN 1395 | SISSSSYIDYAESVKG 1396 | DGDILATIRGSFDY 1397 | RSSQSLLDSDAGNTYLD 1398 | TLSYRAS 1399 | MQRIEFPIT 1400 |
| 43 | VG9B402 | NYGMN 1429 | YISSGSSYKYYADSMKG 1430 | DPVVTEYYYYGMDV 1431 | RASQGINSWLA 1432 | AASSLQS 1433 | QQANSFPWT 1434 |
| 44 | VG9B127 | AYTMN 1463 | SISSSSYIDFAESVKG 1464 | DGDIVSTIRGSFDY 1465 | RSSQSLLDSDDGNTYLD 1466 | TLSYRAS 1467 | MQRIEFPIT 1468 |
| 45 | VG9B137 | SYSMD 1497 | SIGSSSYIFYADSVKG 1498 | SYSWNYGGAFDI 1499 | RASQSVSSSYLA 1500 | GASSRAT 1501 | QQYGSSPPYT 1502 |
| 46 | VG9B33 | SYNMN 1531 | SISTSSSYIYYADSVKG 1532 | DTSVTKYPDTFDI 1533 | RASQDINNYLA 1534 | GASTLQS 1535 | QKYNSAPFT 1536 |
| 47 | VG9B162 | GDYMH 1565 | WINPNSGYTNYAQKFQG 1566 | EGDAFDV 1567 | TGTSSDVGGYNYVS 1568 | EVSKRPS 1569 | NSYAGSNNFEV 1570 |
| 48 | VG9B152 | SYSMI 1599 | SISSSSDYIYNADSVKG 1600 | DWELLGFDC 1601 | SGDKLGDKYAC 1602 | QHNKRPS 1603 | QAWDSTTVV 1604 |
| 49 | VG9B64 | ISGVSVG 1633 | LIYWNDDKRYSPSLQS 1634 | SGQWLEGDAFDI 1635 | RSSESLVHSDGNTYLS 1636 | KISNRFS 1637 | MQATQFPLT 1638 |
| 50 | VG9B21 | NYDMN 1667 | SISSSHYIYYADSLKG 1668 | DRGVTTDYYYALDV 1669 | RASQGIYNYLA 1670 | AASTLQS 1671 | QKYNRAPFT 1672 |

TABLE 3-continued

Kabat CDR Amino Acid Sequences

| Protein # Name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|
| 51 VG9B128 | TYGMH 1701 | VIWYNGSNKYYADSVKG 1702 | GGFGESFDS 1703 | RASQSVIDYLA 1704 | DASNRAT 1705 | QQRSNWPLT 1706 |
| 52 VG9B66 | TYTMN 1735 | SISSSSFYMDYADSVKG 1736 | DGDIVATIRGSFDY 1737 | RASQDITNFLA 1738 | TASTLQS 1739 | QKYNSAPFT 1740 |
| 53 VG9B32 | RYAMN 1769 | FISGTGYTVYYADSVKG 1770 | DQEPGFDY 1771 | RSGQSLVHSDGNTYLS 1772 | KISSNRFS 1773 | MQATHFPFT 1774 |
| 54 VG9B57 | SHDMN 1803 | SISSSSYIFYADSVKG 1804 | DLGVGVRDYYYYGMDV 1805 | RASQDCNYLA 1806 | AASSLQG 1807 | LQHDTYPYT 1808 |
| 55 VG9B135 | TYGVGVG 1837 | LIYWNDDKRYYPSLNN 1838 | DYDFWSGYFDY 1839 | RASQSVSSSYLA 1840 | GASSRAT 1841 | QQYGSSPLT 1842 |
| 56 VG9B60 | GYYMH 1871 | RINPNSGVTHYAQKFQG 1872 | GGSLVRGVISGLDY 1873 | RASQSFSGSYLA 1874 | GASSRAT 1875 | QQYGSSPPYT 1876 |
| 57 VG9B409 | SYYMH 1905 | IINPSGGSTSYAQKFQG 1906 | GSYGWYFDL 1907 | RASQSVTSSYLA 1908 | GASSRAT 1909 | QQYGSSPPYT 1910 |
| 58 VG9B411 | NYDMN 1939 | SISSSSYIYYADSVKG 1940 | DVGVTTDYYYYGMDV 1941 | RASQGINSWLA 1942 | AASTLQS 1943 | QQYNWPRT 1944 |
| 59 VG9B129 | SYVIS 1973 | GILPILSTANYAQKFQG 1974 | AHDYYYGMDV 1975 | RASQSVSNNYLA 1976 | GASSRAT 1977 | QQYGSSPPYT 1978 |
| 60 VG9B396 | GYYWN 2007 | RIFTTGNTNYNPSLKS 2008 | EKWDSSSSALYFDF 2009 | TGSSSNIGADYDVK 2010 | GNTDRPS 2011 | QSYDSRLTGYVV 2012 |
| 61 VG9B470 | TSGVGVG 2041 | LILWNDHTIYSPSLKS 2042 | DKWELRDAFDI 2043 | RASQGISRYLA 2044 | VASTLQS 2045 | QQLISYPYT 2046 |
| 62 VG9B111 | TYSVN 2075 | SISSDSSYIFYADSMKG 2076 | DSVTGPFDY 2077 | QASQDISHYLN 2078 | DSYILET 2079 | QQYDNLPYT 2080 |
| 63 VG9B169 | NYFWN 2109 | YIFYSGSTSYNPSLKS 2110 | VGRWELRTAFDI 2111 | SGSSSNIGSNTVN 2112 | SNNQRPS 2113 | AAWDDSLNGPGV 2114 |
| 64 VG9B639 | TYRMN 2143 | SISSSSIYIHSADSVKG 2144 | ERVYTVSFDY 2145 | QASQDISHYLN 2146 | DSYILET 2147 | QQYDNLPYT 2148 |
| 65 VG9B201 | THGVGVG 2177 | LIYWNADKHYSPSLKS 2178 | EGDWGHYFDF 2179 | SGSSSNIGNNDVS 2180 | DNNRRPS 2181 | ETWDSSLSAIWV 2182 |
| 66 VG9B161 | SYFWS 2211 | YIFYSGSTNYNPSLKS 2212 | VGRWELRGAFDI 2213 | SGSSSNIGSNTVN 2214 | SNNQRPS 2215 | AAWDDSLNSPGV 2216 |
| 67 VG9B383 | SYYWN 2245 | RIYTIGNTNYNPSLKS 2246 | EGYYDSSGSFFPGAFGI 2247 | TGTSNDVGSYNLVS 2248 | AGSKRPS 2249 | CSFAGATNVV 2250 |
| 68 VG9B382 | GYYWN 2279 | RIFTTGNTNYNPSLKS 2280 | ERWDSSSSALYFDY 2281 | TGSSSNIGADYDIK 2282 | GNSNRPS 2283 | QSYDSSMSGYVV 2284 |
| 69 VG9B156 | GYFWN 2313 | YIFYSGSTNYNPSLKS 2314 | LGKWELRTAFDI 2315 | SGSTSNIGSDTVN 2316 | SNNQRPS 2317 | AAWDDSLNGPV 2318 |
| 70 VG9B205 | GYFWN 2347 | YIFYSGSTNYNPSLKS 2348 | LGKWELRTAFDI 2349 | SGDKLGDKYAC 2350 | QDSKRPS 2351 | QAWDSSTVV 2352 |
| 71 VG9B86 | SSYWS 2381 | RFYSSGSTSYNPSLKS 2382 | YSGSYWYFDL 2383 | RASQSVSSYLA 2384 | DTSNRAT 2385 | QQRSDWLLT 2386 |
| 72 VG9B154 | YYFWN 2415 | YIYYSGSTNYNPSLKS 2416 | EGKWELRTTFDI 2417 | SGSSSNIGSNTVN 2418 | SNNQRPS 2419 | AAWDDSLNGPV 2420 |
| 73 VG9B159 | SYYWS 2449 | RFYTGGRNNYNPSFKS 2450 | DMEYYYDRSGYSYWYFDL 2451 | GGNNIGSKSVH 2452 | DDSDRPS 2453 | QVWDSSSDHVV 2454 |
| 74 VG9B465 | SYYWN 2483 | RIYTIGNTNYNPSLKS 2484 | EGYYESDGSFFPGAFNI 2485 | TGTSNDVGSYNLVS 2486 | AGSKRPS 2487 | CSYAGTTNVV 2488 |
| 75 VG9B194 | GDYMH 2517 | WINPNSGYTNNAEKFQG 2518 | ELDALDV 2519 | TGTSSDVGGYNYVS 2520 | EVSKRPS 2521 | NSYAGSNNFEV 2522 |

TABLE 3-continued

Kabat CDR Amino Acid Sequences

| # | Protein Name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|---|
| 76 | VG9B182 | NHFWS 2551 | FVFYNGNTNYNPSLKS 2552 | VGRWVLRTAFDI 2553 | SGSSSNIGSNTVN 2554 | SNNQRPS 2555 | AAWDDSLNGPGV 2556 |
| 77 | VG9B173 | NYFWS 2585 | YIYYSGSTNYNPSLKS 2586 | EGKWELRSAFDI 2587 | SGSSSNIESNTVN 2588 | SNNQRPS 2589 | TAWDDSLNGPV 2590 |
| 78 | VG9B87 | SEYIH 2619 | IINPSGGSTSYAQRFQG 2620 | ERGYSYGSFDY 2621 | RASQGISSYLA 2622 | AASTLQS 2623 | QQFNSYSLT 2624 |
| 79 | VG9B208 | GYYWS 2653 | YIFYSGSINYNPSLKN 2654 | VGKWELRSSFDI 2655 | SGSTSNIGNNDVS 2656 | DNNKRPS 2657 | GTWDSSLSVWV 2658 |
| 80 | VG9B372 | NGGFYWS 2687 | YINYSGSTYYNPSLES 2688 | DRNYEWNFDL 2689 | RASQSVSSYLA 2690 | DASNRAT 2691 | QQRSNWPLT 2692 |
| 81 | VG9B186 | NIRMSVS 2721 | HIFSNDEKSYNSSLKS 2722 | MRLPYGMDV 2723 | SGSTSNIGSNTVN 2724 | SNNQRPS 2725 | AAWDDSLNGPV 2726 |
| 82 | VG9B177 | NYFWS 2755 | YIFYSGSTNYNPSLKS 2756 | VGKWELRTAFDI 2757 | TGTSSDVADYNYVS 2758 | EVSNRPS 2759 | CSYTSSFTVV 2760 |
| 83 | VG9B114 | RYDMH 2789 | AIGSAGDTYYPGSVKG 2790 | GKWELRDAFDI 2791 | RASQGIHSYLA 2792 | VASTLQS 2793 | QQLNSYPYT 2794 |
| 84 | VG9B147 | GYFWN 2823 | YIFYSGSTNYNPSLKS 2824 | EGKWELRSTFDI 2825 | QGDSLRSYYAT 2826 | GENNRPS 2827 | NSRDTGDHHLV 2828 |
| 85 | VG9B65 | IYAIN 2857 | GIIPFFGTANYAQKFQD 2858 | GGDSGYDWGFDY 2859 | RSSQSLVHSDGNTYLS 2860 | QISNRFS 2861 | MQATQFPLT 2862 |
| 86 | VG9B81 | TYYWS 2891 | RIYTSDNTNYNPSLKS 2892 | YNWNYWYFDL 2893 | RASQGISSYLA 2894 | TASTLQS 2895 | QHLNSYPYT 2896 |
| 87 | VG9B203 | FTYYWN 2925 | RIYTSGSTNYNPSLKS 2926 | SGGNFYWYFDL 2927 | SGSSSNIGNNYVS 2928 | DNNKRPS 2929 | GTWDSSLSAGV 2930 |
| 88 | VG9B380 | NYYWS 2959 | RIYPSGITSYDPSLKS 2960 | IMGTKGAFDI 2961 | TGTSSDVGGYNYVS 2962 | EVSNRPS 2963 | SSYTSTSVV 2964 |
| 89 | VG9B103 | SYAIS 2993 | GIIPIFGTATYAQKFQD 2994 | GVGWGTDYYYGLDV 2995 | RSSQGLVHSDGNTYLS 2996 | KISNRFS 2997 | MQATHHPLT 2998 |
| 90 | VG9B462 | NYYWS 3027 | RIYSSGITNYNPSLKS 3028 | IVGVKGAFAI 3029 | TGTSSDVGGYNYVS 3030 | EVSNRPS 3031 | SSYTSTSVV 3032 |
| 91 | VG9B461 | NYYWS 3061 | RIYSSGITNYNPSLKS 3062 | IVGVKGAFAI 3063 | TGTSSDVGGYNYVS 3064 | EVSNRPS 3065 | SSYTSTSVV 3066 |
| 92 | VG9B106 | GYYLH 3095 | WINPSSGDTDYAQTFQG 3096 | ELGIGVFDY 3097 | KSSQSVLYSSNNKNYLG 3098 | WASTRES 3099 | QQYSIPYT 3100 |
| 93 | VG9B115 | TYGVGVG 3129 | LIYWNDDKRYNPSLKS 3130 | ESDWSYYFDY 3131 | RASQSVSSYLA 3132 | DASNRAT 3133 | QQRSSWPWT 3134 |
| 94 | VG9B27 | SYVIS 3163 | GILPILSTANYAQKFQG 3164 | AHDYYYGMDV 3165 | RSSQSLVHSDGNTYLS 3166 | KISNRFS 3167 | MQATHHPLT 3168 |
| 95 | VG9B458 | NYYWS 3197 | RIYSSGITNYNPSLKS 3198 | IVGVKGAFAI 3199 | TGTSSDVGGYNYVS 3200 | EVSNRPS 3201 | SSYTSTSVV 3202 |
| 96 | VG9B131 | SYDMN 3231 | YISSSSTAKYYADSVKG 3232 | EDIVVVTPILQH 3233 | RASQSVSNYLA 3234 | DASNRAT 3235 | QQRSNWT 3236 |
| 97 | VG9B163 | NHGMS 3265 | SITRGGDTTYYPDNVKG 3266 | GPLTVGYAMDY 3267 | SGNSSNIGHNYVS 3268 | DNNQRPS 3269 | GIWDSSLSIVV 3270 |
| 98 | VG9B454 | NYYWS 3299 | RIYSSGITNYNPSLKS 3300 | IVGVKGAFAI 3301 | TGTSSDVGGYNYVS 3302 | EVSNRPS 3303 | SSYTSTSVV 3304 |
| 99 | VG9B439 | NYYWS 3333 | RIYSSGITNYNPSLKS 3334 | IVGVKGAFAI 3335 | TGTSSDVGGYNYVS 3336 | EVSNRPS 3337 | SSYTSTSVV 3338 |
| 100 | VG9B68 | TYAIS 3367 | GIIPIFGTATYAQRFQD 3368 | GVGWGSDYYYGLDV 3369 | RSSQSLVHSDGNTYLS 3370 | KISNRFS 3371 | IQATHHPLT 3372 |

TABLE 3-continued

Kabat CDR Amino Acid Sequences

| # | Protein Name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|---|
| 101 | VG9B449 | NYYWS 3401 | RIYSSGITNYNPSLKS 3402 | IVGVKGAFAI 3403 | TGTSSDVGGYNYVS 3404 | EVSNRPS 3405 | SSYTSTSVV 3406 |
| 102 | VG9B204 | SFYWS 3435 | RIYTSGGTIYNPSLKS 3436 | WLRAFDY 3437 | SGDKLGDKYAC 3438 | QDSKRPS 3439 | QAWDSSTVV 3440 |
| 103 | VG9B459 | NYYWS 3469 | RIYSSGITNYNPSLKS 3470 | IVGVKGAFAI 3471 | TGTSSDVGGYNYVS 3472 | EVSNRPS 3473 | SSYTSTSVV 3474 |
| 104 | VG9B157 | NHGMS 3503 | SITRGGDTTYYPDNVKG 3504 | GPLTVGYAMDY 3505 | QGDSLRSYYAT 3506 | GENNRPS 3507 | NSRDTGDHHLV 3508 |
| 105 | VG9B453 | NYYWS 3537 | RIYSSGITNYNPSLKS 3538 | IVGVKGAFAI 3539 | TGTSSDVGGYNYVS 3540 | EVSNRPS 3541 | SSYTSTSVV 3542 |
| 106 | VG9B443 | NYYWS 3571 | RIYSSGITNYNPSLKS 3572 | IVGVKGAFAI 3573 | TGTSSDVGGYNYVS 3574 | EVSNRPS 3575 | SSYTSTSVV 3576 |
| 107 | VG9B455 | NYYWS 3605 | RIYSSGITNYNPSLKS 3606 | IVGVKGAFAI 3607 | TGTSSDVGGYNYVS 3608 | EVSNRPS 3609 | SSYTSTSVV 3610 |
| 108 | VG9B466 | NYYWS 3639 | RIYSSGITNYNPSLKS 3640 | IVGVKGAFAI 3641 | TGTSSDVGGYNYVS 3642 | EVSNRPS 3643 | SSYTSTSVV 3644 |
| 109 | VG9B450 | NYYWS 3673 | RIYSSGITNYNPSLKS 3674 | IVGVKGAFAI 3675 | TGTSSDVGGYNYVS 3676 | EVSNRPS 3677 | SSYTSTSVV 3678 |
| 110 | VG9B438 | NYYWS 3707 | RIYSSGITNYNPSLKS 3708 | IVGVKGAFAI 3709 | TGTSSDVGGYNYVS 3710 | EVSNRPS 3711 | SSYTSTSVV 3712 |
| 111 | VG9B464 | NYYWS 3741 | RIYSSGITNYNPSLKS 3742 | IVGVKGAFAI 3743 | TGTSSDVGGYNYVS 3744 | EVSNRPS 3745 | SSYTSTSVV 3746 |
| 112 | VG9B437 | NYYWS 3775 | RIYSSGITNYNPSLKS 3776 | IVGVKGAFAI 3777 | TGTSSDVGGYNYVS 3778 | EVSNRPS 3779 | SSYTSTSVV 3780 |
| 113 | VG9B457 | NYYWS 3809 | RIYSSGITNYNPSLKS 3810 | IVGVKGAFAI 3811 | TGTSSDVGGYNYVS 3812 | EVSNRPS 3813 | SSYTSTSVV 3814 |
| 114 | VG9B442 | NYYWS 3843 | RIYSSGITNYNPSLKS 3844 | IVGVKGAFAI 3845 | TGTSSDVGGYNYVS 3846 | EVSNRPS 3847 | SSYTSTSVV 3848 |
| 115 | VG9B436 | NYYWS 3877 | RIYSSGITNYNPSLKS 3878 | IVGVKGAFAI 3879 | TGTSSDVGGYNYVS 3880 | EVSNRPS 3881 | SSYTSTSVV 3882 |
| 116 | VG9B434 | NYYWS 3911 | RIYSSGITNYNPSLKS 3912 | IVGVKGAFAI 3913 | TGTSSDVGGYNYVS 3914 | EVSNRPS 3915 | SSYTSTSVV 3916 |
| 117 | VG9B460 | NYYWS 3945 | RIYSSGITNYNPSLKS 3946 | IVGVKGAFAI 3947 | TGTSSDVGGYNYVS 3948 | EVSNRPS 3949 | SSYTSTSVV 3950 |
| 118 | VG9B189 | NHGMS 3979 | SITRGGDTTYYPDNVKG 3980 | GPLTVGYAMDY 3981 | TGTSSDVGGYNYVS 3982 | EVSKRPS 3983 | NSYAGSNNFEV 3984 |
| 119 | VG9B452 | NYYWS 4013 | RIYSSGITNYNPSLKS 4014 | IVGVKGAFAI 4015 | TGTSSDVGGYNYVS 4016 | EVSNRPS 4017 | SSYTSTSVV 4018 |
| 120 | VG9B53 | SYYWS 4047 | RIHTIGSINYNPSLKS 4048 | EGVGATNYYYGMAV 4049 | RSSQSLLHSNGYNYLD 4050 | LGSNRAS 4051 | MQALQTPYT 4052 |
| 121 | VG9B41 | TYWMH 4081 | LIDPSDSETRLNQKFKD 4082 | NRWLLG 4083 | RSSQSLVHSDGNTYLS 4084 | KISNRFS 4085 | VQTREFPLT 4086 |
| 122 | VG9B136 | SNRAAWN 4115 | RTYYRSKWYNEYAASVKS 4116 | DLWELREACDI 4117 | RASQGISSYLA 4118 | VASTLQS 4119 | QQLNSYPFT 4120 |
| 123 | VG9B399 | NYDMN 4149 | SISSSSYIYYADSVKG 4150 | DVGVTTDYYYGMDV 4151 | RASQSVASSYLA 4152 | GASSRAT 4153 | QQYGSSPPYT 4154 |
| 124 | VG9B369 | TIGVGVG 4183 | LIYWNDDKRYNPSLKS 4184 | SHDWVHAFDI 4185 | QASQDISHYLN 4186 | DASNLDT 4187 | QQYDNPPLT 4188 |
| 125 | VG9B144 | GYYMH 4217 | WINPNSGATNKEQKFQG 4218 | EDDAFDV 4219 | QGDNLRNYYAT 4220 | GKNNRPS 4221 | NSRDSSGNHVV 4222 |

TABLE 3-continued

Kabat CDR Amino Acid Sequences

| # | Protein Name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|---|
| 126 | VG9B410 | NYGMN 4251 | YISSGSSYKYYADSMKG 4252 | DPVVTEYYYYGMDV 4253 | RASQGINSWLA 4254 | AASSLQS 4255 | QQANSFPWT 4256 |
| 127 | VG9B386 | SYSMI 4285 | SIGSSSTYIYYADSVRG 4286 | DGETGGFDY 4287 | RASQSISRSYLA 4288 | GPSNRAT 4289 | QQYGSLPLT 4290 |
| 128 | VG9B125 | SYDMN 4319 | YISSSSTAKYYADSVKG 4320 | EDIVVVTPILQH 4321 | RASQSVSKDLA 4322 | DASNRAT 4323 | QQRINWPLFT 4324 |
| 129 | VG9B112 | SNSAAWN 4353 | GTYYRSKWFNNYAVSVKS 4354 | GEWGLRDAFDI 4355 | RASQGIHSYLA 4356 | VASTLQS 4357 | QQLNSYPWT 4358 |
| 130 | VG9B371 | SYDMN 4387 | SISSSSSYIYYADSVKG 4388 | DRGVGGTDYYYYGLDV 4389 | RASQSVSSSYLA 4390 | GASSRAT 4391 | QQYGSSPPYT 4392 |
| 131 | VG9B387 | GYYLQ 4421 | WINPNSGYTDYAQRFQD 4422 | LDDAFDV 4423 | QGDSLRNYYAI 4424 | GKNNRPS 4425 | NSRDSSGNHWV 4426 |
| 132 | VG9B47 | NYAIS 4455 | GIIPFFGTPDYAQKFQG 4456 | GGGYGDYDYYYGINV 4457 | RSSQSLVHSDGNTYLS 4458 | KISNRFS 4459 | MQAKEFPLT 4460 |
| 133 | VG9B379 | GDYIH 4489 | WINPNSGGTNYAQKFQG 4490 | EGGVAPAAPDAFDI 4491 | QGDSLRSYYAR 4492 | GKNNRPS 4493 | NSRDSSGNHRV 4494 |
| 134 | VG9B447 | NYYWS 4523 | RIYSSGITNYNPSLKS 4524 | IVGVKGAFAI 4525 | TGTSSDVGGYNYVS 4526 | EVSNRPS 4527 | SSYTSTSVV 4528 |
| 135 | VG9B392 | GYYIH 4557 | WINPNSGYTNSAQKFQG 4558 | EDDAFDI 4559 | QGDSLRSYYAR 4560 | GKNNRPS 4561 | NSRDNSGNHVV 4562 |
| 136 | VG9B96 | NYAIS 4591 | GIIPIFSAGTYAQRFQG 4592 | NSGTYYDYYYGMDV 4593 | RSSQSLVHSDGNTYLS 4594 | KIFNRLS 4595 | MQAKQFPLT 4596 |
| 137 | VG9B77 | SYAIS 4625 | GIIPFFGTADYAQKFQG 4626 | ATVTTDYYYYGMDV 4627 | RSSQSLVHSDGNTYLS 4628 | EISNRFT 4629 | MQARQFPLT 4630 |

TABLE 4

Chothia CDR Amino Acid Sequences

| # | Protein Name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|---|
| 1 | VG9B54 | GFAFSSY 7 | SSSSSY 8 | DGELGPFD 9 | SQSVSSSY 10 | GAS 11 | YGRSPL 12 |
| 2 | VG9B121 | GFTFSDY 41 | SSTSNY 42 | SYNWNYGGAFD 43 | SQSVSSSY 44 | GAS 45 | YGRSPL 46 |
| 3 | VG9B429 | GFTFSNY 75 | SSSSSY 76 | DVGVTTDYYYYGMD 77 | SQGINSW 78 | AAS 79 | ANSFPW 80 |
| 4 | VG9B370 | RFTLSSY 109 | SSSSSY 110 | DRGVGGTDYYYYGLD 111 | SQSVSSSY 112 | GAS 113 | YGSSPPY 114 |
| 5 | VG9B80 | GFTFSTY 143 | SSSSSY 144 | DGELGVFD 145 | SQSISSSY 146 | GPS 147 | FGRSPL 148 |
| 6 | VG9B414 | GFTFSNY 177 | SSSSSY 178 | DVGVTTDYYYYGMD 179 | SQGINSW 180 | AAS 181 | ANSFPW 182 |
| 7 | VG9B195 | GFTFSPY 211 | SSSSSY 212 | DGDLVGPTYYFD 213 | DKLGDKY 214 | QHN 215 | WDSTTV 216 |
| 8 | VG9B140 | GFTFRSY 245 | STSSGY 246 | DRGIAVAGDYYYGMD 247 | SQSVSSSY 248 | GAS 249 | YGSSPPY 250 |
| 9 | VG9B426 | GFTFSNY 279 | SSSSSY 280 | DVGVTTDYYYYGMD 281 | SQSVASSY 282 | GAS 283 | YGSSPPY 284 |

TABLE 4-continued

Chothia CDR Amino Acid Sequences

| # | Protein Name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|---|
| 10 | VG9B46 | GFTFSIN 313 | SSTSDY 314 | DDVFGAFD 315 | SQSVSRSY 316 | GSS 317 | YSRSPL 318 |
| 11 | VG9B416 | GFTFSNY 347 | SSSSSY 348 | DVGVTTDYYYYGMD 349 | SQSVASSY 350 | GAS 351 | YGSSPPY 352 |
| 12 | VG9B69 | GFTFSSY 381 | TSSSYY 382 | DLGVRGVDYYYYGLD 383 | SQSVSSSY 384 | GAS 385 | YGSSPPY 386 |
| 13 | VG9B415 | GFTFSNY 415 | SSSSSY 416 | DVGVTTDYYYYGMD 417 | SQSVASSY 418 | GAS 419 | YGSSPPY 420 |
| 14 | VG9B104 | GFTFSVY 449 | GSSSSY 450 | DHDYGGLD 451 | SQSVSSSY 452 | GPS 453 | YGRSPL 454 |
| 15 | VG9B198 | GDSISSI 483 | YTTDI 484 | NGYSYGGFN 485 | SSSNIGAGYD 486 | GDS 487 | YDSSLSVV 488 |
| 16 | VG9B463 | GFTFSNY 517 | SSSSSY 518 | DVGVTTDYYYYGMD 519 | SSSNIGSNT 520 | TNT 521 | WDDSLNAW 522 |
| 17 | VG9B469 | GFTFSHY 551 | SSSSSY 552 | DRGVGDTSDYYSFGLD 553 | SQNVSSTY 554 | GAC 555 | YGSSPPY 556 |
| 18 | VG9B428 | GFTFSNY 585 | SSGSSY 586 | DPVVTEYYYYGMD 587 | SQGINSW 588 | AAS 589 | ANSFPW 590 |
| 19 | VG9B430 | GFTFSSY 619 | SSSSSY 620 | DVGVTTDYYYYGMD 621 | SQSVASSY 622 | GAS 623 | YGSSPPY 624 |
| 20 | VG9B423 | GFTFSNY 653 | SSSSSY 654 | DVGVTTDYYYYGMD 655 | SQSVASSY 656 | GAS 657 | YGSSPPY 658 |
| 21 | VG9B98 | GFTFSSY 687 | GSSSTY 688 | DGELGPFE 689 | SQSVSTSY 690 | GTS 691 | YGRSPL 692 |
| 22 | VG9B73 | GFTFSNY 721 | SSSSSY 722 | EIGVTGTTYYQDYGMD 723 | SQSFSSNY 724 | GAS 725 | YGSSPPF 726 |
| 23 | VG9B133 | GFTFSNY 755 | SSSSSY 756 | DLGITGTTMDYYYYGMD 757 | SQSVSSSY 758 | GAS 759 | YGSSPPY 760 |
| 24 | VG9B368 | GFTFNSY 789 | SSSSSY 790 | DRGIGGDYYSYAMD 791 | SQSVSSSY 792 | GAS 793 | YGSSPPY 794 |
| 25 | VG9B424 | GFTFSNY 823 | SSSSSY 824 | DVGVTTDYYYYGMD 825 | SQSVASSY 826 | GAS 827 | YGSSPPY 828 |
| 26 | VG9B427 | GFTFSNY 857 | SSSSSY 858 | DVGVTTDYYYYGMD 859 | SQSVASSY 860 | GAS 861 | YGSSPPY 862 |
| 27 | VG9B417 | GFTFSNY 891 | SSGSSY 892 | DPVVTEYYYYGMD 893 | SQGINSW 894 | AAS 895 | ANSFPW 896 |
| 28 | VG9B58 | GGSIKSS 925 | FYLGS 926 | ERPVLDAFD 927 | SQDITNY 928 | AAS 929 | HDTYPY 930 |
| 29 | VG9B419 | GFTFSNY 959 | SSSSSY 960 | DVGVTTDYYYYGMD 961 | SQSVASSY 962 | GAS 963 | YGSSPPY 964 |
| 30 | VG9B425 | GFTFSNY 993 | SSSSSY 994 | DVGVTTDYYYYGMD 995 | SQSVASSY 996 | GAS 997 | YGSSPPY 998 |
| 31 | VG9B143 | GFTFSTY 1027 | STSSYT 1028 | EGDWWYFD 1029 | TSSDVGGYNY 1030 | EVS 1031 | YTSSSTL 1032 |
| 32 | VG9B418 | GFTFSNY 1061 | SSSSSY 1062 | DVGVTTDYYYYGMD 1063 | SQSVASSY 1064 | GAS 1065 | YGSSPPY 1066 |
| 33 | VG9B472 | GFTFSHY 1095 | SSSSSY 1096 | DRGVGDTSDYYSFGLD 1097 | SQGIATY 1098 | AAS 1099 | YNSAPPW 1100 |

TABLE 4-continued

Chothia CDR Amino Acid Sequences

| # | Protein Name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|---|
| 34 | VG9B421 | GFTFSNY 1129 | SSGSSY 1130 | DPVVTEYYYYGMD 1131 | SQGINSW 1132 | AAS 1133 | ANSFPW 1134 |
| 35 | VG9B88 | GFTFSSY 1163 | STSSSY 1164 | DGDMVAPIKGSFD 1165 | SQSLLNSDDGNTY 1166 | TLS 1167 | RIEFPI 1168 |
| 36 | VG9B384 | GFSLSSSGM 1197 | DWFDD 1198 | IRGTGAYYYGLD 1199 | NELGDKY 1200 | QDN 1201 | WDSSKV 1202 |
| 37 | VG9B413 | GFTFSNY 1231 | SSSSSY 1232 | DVGVTTDYYYYGMD 1233 | SQSVASSY 1234 | GAS 1235 | YGSSPPY 1236 |
| 38 | VG9B36 | GFTFSSY 1265 | STGSSY 1266 | DKGLAVTGYIMD 1267 | SQDISNY 1268 | DAS 1269 | YDNLPMY 1270 |
| 39 | VG9B403 | GFTFSNY 1299 | SSSSSY 1300 | DVGVTTDYYYYGMD 1301 | SQSVASSY 1302 | GAS 1303 | YGSSPPY 1304 |
| 40 | VG9B191 | GFTFSRY 1333 | SSSSSY 1334 | DGPTVNWDYYFD 1335 | SSSNIGNNY 1336 | DNN 1337 | WDSSLSTSV 1338 |
| 41 | VG9B44 | GDSVSSNSA 1367 | YYRSKWY 1368 | ESGSYYTDGFD 1369 | SQGISSY 1370 | AAS 1371 | FNSYPY 1372 |
| 42 | VG9B67 | GFTFSSY 1401 | SSSSSY 1402 | DGDILATIRGSFD 1403 | SQSLLDSDAGNTY 1404 | TLS 1405 | RIEFPI 1406 |
| 43 | VG9B402 | GFTFSNY 1435 | SSGSSY 1436 | DPVVTEYYYYGMD 1437 | SQGINSW 1438 | AAS 1439 | ANSFPW 1440 |
| 44 | VG9B127 | GFTFGAY 1469 | SSSSSY 1470 | DGDIVSTIRGSFD 1471 | SQSLLDSDDGNTY 1472 | TLS 1473 | RIEFPI 1474 |
| 45 | VG9B137 | GITFSSY 1503 | GSSSSY 1504 | SYSWNYGGAFD 1505 | SQSVSSSY 1506 | GAS 1507 | YGSSPPY 1508 |
| 46 | VG9B33 | GFTFSSY 1537 | STSSSY 1538 | DTSVTKYPDTFD 1539 | SQDINNY 1540 | GAS 1541 | YNSAPF 1542 |
| 47 | VG9B162 | GYTFTGD 1571 | NPNSGY 1572 | EGDAFD 1573 | TSSDVGGYNY 1574 | EVS 1575 | YAGSNNFE 1576 |
| 48 | VG9B152 | GFTFSSY 1605 | SSSSDY 1606 | DWELLGFD 1607 | DKLGDKY 1608 | QHN 1609 | WDSTTV 1610 |
| 49 | VG9B64 | GFSLSISGV 1639 | YWNDD 1640 | SGQWLEGDAFD 1641 | SESLVHSDGNTY 1642 | KIS 1643 | ATQFPL 1644 |
| 50 | VG9B21 | GFSFSNY 1673 | SSSSHY 1674 | DRGVTTDYYYYALD 1675 | SQGIYNY 1676 | AAS 1677 | YNRAPF 1678 |
| 51 | VG9B128 | GFTFGTY 1707 | WYNGSN 1708 | GGFGESFD 1709 | SQSVIDY 1710 | DAS 1711 | RSNWPL 1712 |
| 52 | VG9B66 | GFTFSTY 1741 | SSSSFY 1742 | DGDIVATIRGSFD 1743 | SQDITNF 1744 | TAS 1745 | YNSAPF 1746 |
| 53 | VG9B32 | GFTFSRY 1775 | SGTGYT 1776 | DQEPGFD 1777 | GQSLVHSDGNTY 1778 | KIS 1779 | ATHFPF 1780 |
| 54 | VG9B57 | GFTFSSH 1809 | SSSSSY 1810 | DLGVGVRDYYYYGMD 1811 | SQDITNY 1812 | AAS 1813 | HDTYPY 1814 |
| 55 | VG9B135 | GFSLTTYGV 1843 | YWNDD 1844 | DYDFWSGYFD 1845 | SQSVSSSY 1846 | GAS 1847 | YGSSPL 1848 |
| 56 | VG9B60 | GYTFTGY 1877 | NPNSGV 1878 | GGSLVRGVISGLD 1879 | SQSFSGY 1880 | GAS 1881 | YGSSPPY 1882 |
| 57 | VG9B409 | GYTLTSY 1911 | NPSGGS 1912 | GSYGWYFD 1913 | SQSVTSSY 1914 | GAS 1915 | YGSSPPY 1916 |

TABLE 4-continued

Chothia CDR Amino Acid Sequences

| # | Protein Name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|---|
| 58 | VG9B411 | GFTFSNY 1945 | SSSSSY 1946 | DVGVTTDYYYYGMD 1947 | SQGINSW 1948 | AAS 1949 | YNNWPR 1950 |
| 59 | VG9B129 | GGTFSSY 1979 | LPILST 1980 | AHDYYYGMD 1981 | SQSVSNNY 1982 | GAS 1983 | YGSSPPY 1984 |
| 60 | VG9B396 | GDSIRGY 2013 | FTTGN 2014 | EKWDSSSSALYFD 2015 | SSSNIGADYD 2016 | GNT 2017 | YDSRLTGYV 2018 |
| 61 | VG9B470 | GFSLTTSGV 2047 | LWNDH 2048 | DKWELRDAFD 2049 | SQGISRY 2050 | VAS 2051 | LISYPY 2052 |
| 62 | VG9B111 | GFTFSTY 2081 | SSDSSY 2082 | DSVTGPFD 2083 | SQDISHY 2084 | DSY 2085 | YDNLPY 2086 |
| 63 | VG9B169 | GGSITNY 2115 | FYSGS 2116 | VGRWELRTAFD 2117 | SSSNIGSNT 2118 | SNN 2119 | WDDSLNGPG 2120 |
| 64 | VG9B639 | GFTFTTY 2149 | SSSSIY 2150 | ERVYTVSFD 2151 | SQDISHY 2152 | DSY 2153 | YDNLPY 2154 |
| 65 | VG9B201 | GFSLTTHGV 2183 | YWNAD 2184 | EGDWGHYFD 2185 | SSSNIGNND 2186 | DNN 2187 | WDSSLSAIW 2188 |
| 66 | VG9B161 | GGSISSY 2217 | FYSGS 2218 | VGRWELRGAFD 2219 | SSSNIGSNT 2220 | SNN 2221 | WDDSLNSPG 2222 |
| 67 | VG9B383 | SGSISSY 2251 | YTIGN 2252 | EGYYDSSGSFFPGAFG 2253 | TSNDVGSYNL 2254 | AGS 2255 | FAGATNV 2256 |
| 68 | VG9B382 | GDSISGY 2285 | FTTGN 2286 | ERWDSSSSALYFD 2287 | SSSNIGADYD 2288 | GNS 2289 | YDSSMSGYV 2290 |
| 69 | VG9B156 | NGSISGY 2319 | FYSGS 2320 | LGKWELRTAFD 2321 | STSNIGSDT 2322 | SNN 2323 | WDDSLNGP 2324 |
| 70 | VG9B205 | NGSISGY 2353 | FYSGS 2354 | LGKWELRTAFD 2355 | DKLGDKY 2356 | QDS 2357 | WDSSTV 2358 |
| 71 | VG9B86 | GDSISSS 2387 | YSSGS 2388 | YSGSYWYFD 2389 | SQSVSSY 2390 | DTS 2391 | RSDWLL 2392 |
| 72 | VG9B154 | GGSISYY 2421 | YYSGS 2422 | EGKWELRTTFD 2423 | SSSNIGSNT 2424 | SNN 2425 | WDDSLNGP 2426 |
| 73 | VG9B159 | GGSISSY 2455 | YTGGR 2456 | DMEYYYDRSGYSYWYFD 2457 | NNIGSKS 2458 | DDS 2459 | WDSSSDHV 2460 |
| 74 | VG9B465 | GGSITSY 2489 | YTIGN 2490 | EGYYESDGSFFPGAFN 2491 | TSNDVGSYNL 2492 | AGS 2493 | YAGTTNV 2494 |
| 75 | VG9B194 | GYTFTGD 2523 | NPNSGY 2524 | ELDALD 2525 | TSSDVGGYNY 2526 | EVS 2527 | YAGSNNFE 2528 |
| 76 | VG9B182 | GDSINNH 2557 | FYNGN 2558 | VGRWVLRTAFD 2559 | SSSNIGSNT 2560 | SNN 2561 | WDDSLNGPG 2562 |
| 77 | VG9B173 | GGSINNY 2591 | YYSGS 2592 | EGKWELRSAFD 2593 | SSSNIESNT 2594 | SNN 2595 | WDDSLNGP 2596 |
| 78 | VG9B87 | GYTFTSE 2625 | NPSGGS 2626 | ERGYSYGSFD 2627 | SQGISSY 2628 | AAS 2629 | FNSYSL 2630 |
| 79 | VG9B208 | GGSISGY 2659 | FYSGS 2660 | VGKWELRSSFD 2661 | STSNIGNND 2662 | DNN 2663 | WDSSLSVW 2664 |
| 80 | VG9B372 | GGSISNGGF 2693 | NYSGS 2694 | DRNYEWNFD 2695 | SQSVSSY 2696 | DAS 2697 | RSNWPL 2698 |
| 81 | VG9B186 | GFSLTNIRM 2727 | FSNDE 2728 | MRLPYGMD 2729 | STSNIGSNT 2730 | SNN 2731 | WDDSLNGP 2732 |

TABLE 4-continued

Chothia CDR Amino Acid Sequences

| # | Protein Name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|---|
| 82 | VG9B177 | GGSINNY 2761 | FYSGS 2762 | VGKWELRTAFD 2763 | TSSDVADYNY 2764 | EVS 2765 | YTSSFTV 2766 |
| 83 | VG9B114 | GFTFSRY 2795 | GSAGD 2796 | GKWELRDAFD 2797 | SQGIHSY 2798 | VAS 2799 | LNSYPY 2800 |
| 84 | VG9B147 | GGSISGY 2829 | FYSGS 2830 | EGKWELRSTFD 2831 | DSLRSYY 2832 | GEN 2833 | RDTGDHHL 2834 |
| 85 | VG9B65 | GGTFNIY 2863 | IPFFGT 2864 | GGDSGYDWGFD 2865 | SQSLVHSDGNTY 2866 | QIS 2867 | ATQFPL 2868 |
| 86 | VG9B81 | GGSINTY 2897 | YTSDN 2898 | YNWNYWYFD 2899 | SQGISSY 2900 | TAS 2901 | LNSYPY 2902 |
| 87 | VG9B203 | GDSIGHY 2931 | YTSGS 2932 | SGGNFYWYFD 2933 | SSSNIGNNY 2934 | DNN 2935 | WDSSLSAG 2936 |
| 88 | VG9B380 | GGSISNY 2965 | YPSGI 2966 | IMGTKGAFD 2967 | TSSDVGGYNY 2968 | EVS 2969 | YTSTSV 2970 |
| 89 | VG9B103 | GGTFSSY 2999 | IPIFGT 3000 | GVGWGTDYYYGLD 3001 | SQGLVHSDGNTY 3002 | KIS 3003 | ATHHPL 3004 |
| 90 | VG9B462 | GGSISNY 3033 | YSSGI 3034 | IVGVKGAFA 3035 | TSSDVGGYNY 3036 | EVS 3037 | YTSTSV 3038 |
| 91 | VG9B461 | GGSISNY 3067 | YSSGI 3068 | IVGVKGAFA 3069 | TSSDVGGYNY 3070 | EVS 3071 | YTSTSV 3072 |
| 92 | VG9B106 | GYTFTGY 3101 | NPSSGD 3102 | ELGIGVFD 3103 | SQSVLYSSNNKNY 3104 | WAS 3105 | YYSIPY 3106 |
| 93 | VG9B115 | GFSLSTYGV 3135 | YWNDD 3136 | ESDWSYYFD 3137 | SQSVSSY 3138 | DAS 3139 | RSSWPW 3140 |
| 94 | VG9B27 | GGTFSSY 3169 | LPILST 3170 | AHDYYYGMD 3171 | SQSLVHSDGNTY 3172 | KIS 3173 | ATHHPL 3174 |
| 95 | VG9B458 | GGSISNY 3203 | YSSGI 3204 | IVGVKGAFA 3205 | TSSDVGGYNY 3206 | EVS 3207 | YTSTSV 3208 |
| 96 | VG9B131 | GFTFSSY 3237 | SSSSTA 3238 | EDIVVVTPILQ 3239 | SQSVSNY 3240 | DAS 3241 | RSNW 3242 |
| 97 | VG9B163 | GFTFSNH 3271 | TRGGDT 3272 | GPLTVGYAMD 3273 | NSSNIGHY 3274 | DNN 3275 | WDSSLSIV 3276 |
| 98 | VG9B454 | GGSISNY 3305 | YSSGI 3306 | IVGVKGAFA 3307 | TSSDVGGYNY 3308 | EVS 3309 | YTSTSV 3310 |
| 99 | VG9B439 | GGSISNY 3339 | YSSGI 3340 | IVGVKGAFA 3341 | TSSDVGGYNY 3342 | EVS 3343 | YTSTSV 3344 |
| 100 | VG9B68 | GGTFSTY 3373 | IPIFGT 3374 | GVGWGSDYYYGLD 3375 | SQSLVHSDGNTY 3376 | KIS 3377 | ATHHPL 3378 |
| 101 | VG9B449 | GGSISNY 3407 | YSSGI 3408 | IVGVKGAFA 3409 | TSSDVGGYNY 3410 | EVS 3411 | YTSTSV 3412 |
| 102 | VG9B204 | YGSFSSF 3441 | YTSGG 3442 | WLRAFD 3443 | DKLGDKY 3444 | QDS 3445 | WDSSTV 3446 |
| 103 | VG9B459 | GGSISNY 3475 | YSSGI 3476 | IVGVKGAFA 3477 | TSSDVGGYNY 3478 | EVS 3479 | YTSTSV 3480 |
| 104 | VG9B157 | GFTFSNH 3509 | TRGGDT 3510 | GPLTVGYAMD 3511 | DSLRSYY 3512 | GEN 3513 | RDTGDHHL 3514 |
| 105 | VG9B453 | GGSISNY 3543 | YSSGI 3544 | IVGVKGAFA 3545 | TSSDVGGYNY 3546 | EVS 3547 | YTSTSV 3548 |

TABLE 4-continued

Chothia CDR Amino Acid Sequences

| # | Protein Name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|---|
| 106 | VG9B443 | GGSISNY 3577 | YSSGI 3578 | IVGVKGAFA 3579 | TSSDVGGYNY 3580 | EVS 3581 | YTSTSV 3582 |
| 107 | VG9B455 | GGSISNY 3611 | YSSGI 3612 | IVGVKGAFA 3613 | TSSDVGGYNY 3614 | EVS 3615 | YTSTSV 3616 |
| 108 | VG9B466 | GGSISNY 3645 | YSSGI 3646 | IVGVKGAFA 3647 | TSSDVGGYNY 3648 | EVS 3649 | YTSTSV 3650 |
| 109 | VG9B450 | GGSISNY 3679 | YSSGI 3680 | IVGVKGAFA 3681 | TSSDVGGYNY 3682 | EVS 3683 | YTSTSV 3684 |
| 110 | VG9B438 | GGSISNY 3713 | YSSGI 3714 | IVGVKGAFA 3715 | TSSDVGGYNY 3716 | EVS 3717 | YTSTSV 3718 |
| 111 | VG9B464 | GGSISNY 3747 | YSSGI 3748 | IVGVKGAFA 3749 | TSSDVGGYNY 3750 | EVS 3751 | YTSTSV 3752 |
| 112 | VG9B437 | GGSISNY 3781 | YSSGI 3782 | IVGVKGAFA 3783 | TSSDVGGYNY 3784 | EVS 3785 | YTSTSV 3786 |
| 113 | VG9B457 | GGSISNY 3815 | YSSGI 3816 | IVGVKGAFA 3817 | TSSDVGGYNY 3818 | EVS 3819 | YTSTSV 3820 |
| 114 | VG9B442 | GGSISNY 3849 | YSSGI 3850 | IVGVKGAFA 3851 | TSSDVGGYNY 3852 | EVS 3853 | YTSTSV 3854 |
| 115 | VG9B436 | GGSISNY 3883 | YSSGI 3884 | IVGVKGAFA 3885 | TSSDVGGYNY 3886 | EVS 3887 | YTSTSV 3888 |
| 116 | VG9B434 | GGSISNY 3917 | YSSGI 3918 | IVGVKGAFA 3919 | TSSDVGGYNY 3920 | EVS 3921 | YTSTSV 3922 |
| 117 | VG9B460 | GGSISNY 3951 | YSSGI 3952 | IVGVKGAFA 3953 | TSSDVGGYNY 3954 | EVS 3955 | YTSTSV 3956 |
| 118 | VG9B189 | GFTFSNH 3985 | TRGGDT 3986 | GPLTVGYAMD 3987 | TSSDVGGYNY 3988 | EVS 3989 | YAGSNNFE 3990 |
| 119 | VG9B452 | GGSISNY 4019 | YSSGI 4020 | IVGVKGAFA 4021 | TSSDVGGYNY 4022 | EVS 4023 | YTSTSV 4024 |
| 120 | VG9B53 | GGSISSY 4053 | HTIGS 4054 | EGVGATNYYYGMA 4055 | SQSLLHSNGYNY 4056 | LGS 4057 | ALQTPY 4058 |
| 121 | VG9B41 | GYSFTTY 4087 | DPSDSE 4088 | NRWLL 4089 | SQSLVHSDGNTY 4090 | KIS 4091 | TREFPL 4092 |
| 122 | VG9B136 | GDSVSSNRA 4121 | YYRSKWY 4122 | DLWELREACD 4123 | SQGISSY 4124 | VAS 4125 | LNSYPF 4126 |
| 123 | VG9B399 | GFTFSNY 4155 | SSSSSY 4156 | DVGVTTDYYYYGMD 4157 | SQSVASSY 4158 | GAS 4159 | YGSSPPY 4160 |
| 124 | VG9B369 | GFSLSTIGV 4189 | YWNDD 4190 | SHDWVHAFD 4191 | SQDISHY 4192 | DAS 4193 | YDNFPL 4194 |
| 125 | VG9B144 | GYTFTGY 4223 | NPNSGA 4224 | EDDAFD 4225 | DNLRNYY 4226 | GKN 4227 | RDSSGNHV 4228 |
| 126 | VG9B410 | GFTFSNY 4257 | SSGSSY 4258 | DPVVTEYYYYGMD 4259 | SQGINSW 4260 | AAS 4261 | ANSFPW 4262 |
| 127 | VG9B386 | GFTFSSY 4291 | GSSSTY 4292 | DGETGGFD 4293 | SQSISRSY 4294 | GPS 4295 | YGSLPL 4296 |
| 128 | VG9B125 | GFTFSSY 4325 | SSSSTA 4326 | EDIVVVTPILQ 4327 | SQSVSKD 4328 | DAS 4329 | RINWPLF 4330 |
| 129 | VG9B112 | GDSVSSNSA 4359 | YYRSKWF 4360 | GEWGLRDAFD 4361 | SQGIHSY 4362 | VAS 4363 | LNSYPW 4364 |

TABLE 4-continued

Chothia CDR Amino Acid Sequences

| # | Protein Name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|---|
| 130 | VG9B371 | RFTLSSY 4393 | SSSSSY 4394 | DRGVGGTDYYYYGLD 4395 | SQSVSSSY 4396 | GAS 4397 | YGSSPPY 4398 |
| 131 | VG9B387 | GFTFTGY 4427 | NPNSGY 4428 | LDDAFD 4429 | DSLRNYY 4430 | GKN 4431 | RDSSGNHW 4432 |
| 132 | VG9B47 | GGSFSNY 4461 | IPFFGT 4462 | GGGYGDYYYYGIN 4463 | SQSLVHSDGNTY 4464 | KIS 4465 | AKEFPL 4466 |
| 133 | VG9B379 | GYTFTGD 4495 | NPNSGG 4496 | EGGVAPAAPDAFD 4497 | DSLRSYY 4498 | GKN 4499 | RDSSGNHR 4500 |
| 134 | VG9B447 | GGSISNY 4529 | YSSGI 4530 | IVGVKGAFA 4531 | TSSDVGGYNY 4532 | EVS 4533 | YTSTSV 4534 |
| 135 | VG9B392 | GYTFTGY 4563 | NPNSGY 4564 | EDDAFD 4565 | DSLRSYY 4566 | GKN 4567 | RDNSGNHV 4568 |
| 136 | VG9B96 | GGTFSNY 4597 | IPIFSA 4598 | NSGTYYDYYYGMD 4599 | SQSLVHSDGNTY 4600 | KIF 4601 | AKQFPL 4602 |
| 137 | VG9B77 | GGTFSSY 4631 | IPFFGT 4632 | ATVTTDYYYGMD 4633 | SQSLVHSDGNTY 4634 | EIS 4635 | ARQFPL 4636 |

TABLE 5

AbM CDR Amino Acid Sequences

| # | Protein Name | HC AbM CDR1 | HC AbM CDR2 | HC AbM CDR3 | LC AbM CDR1 | LC AbM CDR2 | LC AbM CDR3 |
|---|---|---|---|---|---|---|---|
| 1 | VG9B54 | GFAFSSYSLT 13 | SISSSSSYIF 14 | DGELGPFDY 15 | RASQSVSSSYLA 16 | GASSRAT 17 | QQYGRSPLT 18 |
| 2 | VG9B121 | GFTFSDYAMD 47 | SISSTSNYIF 48 | SYNWNYGGAFDI 49 | RASQSVSSSYFA 50 | GASSRAT 51 | QQYGRSPLT 52 |
| 3 | VG9B429 | GFTFSNYDMN 81 | SISSSSSYIY 82 | DVGVTTDYYYYGMDV 83 | RASQGINSWLA 84 | AASSLQS 85 | QQANSFPWT 86 |
| 4 | VG9B370 | RFTLSSYDMN 115 | SISSSSSYIY 116 | DRGVGGTDYYYYGLDV 117 | RASQSVSSSYLA 118 | GASSRAT 119 | QQYGSSPPYT 120 |
| 5 | VG9B80 | GFTFSTYSMN 149 | SISSSSSYIF 150 | DGELGVFDY 151 | RASQSISSSYLA 152 | GPSGRAT 153 | QQFGRSPLT 154 |
| 6 | VG9B414 | GFTFSNYDMN 183 | SISSSSSYIY 184 | DVGVTTDYYYYGMDV 185 | RASQGINSWLA 186 | AASSLQS 187 | QQANSFPWT 188 |
| 7 | VG9B195 | GFTFSPYTMN 217 | SISSSSSYMY 218 | DGDLVGPTYYFDY 219 | SGDKLGDKYAC 220 | QHNKRPS 221 | QAWDSTTVV 222 |
| 8 | VG9B140 | GFTFRSYDMN 251 | SISTSSGYIY 252 | DRGIAVAGDYYYGMDV 253 | RASQSVSSSYLA 254 | GASSRAT 255 | QQYGSSPPYT 256 |
| 9 | VG9B426 | GFTFSNYDMN 285 | SISSSSSYIY 286 | DVGVTTDYYYYGMDV 287 | RASQSVASSYLA 288 | GASSRAT 289 | QQYGSSPPYT 290 |
| 10 | VG9B46 | GFTFSINSMN 319 | SISSTSDYIF 320 | DDVFGAFDI 321 | RTSQSVSRSYLG 322 | GSSSRAT 323 | QQYSRSPLT 324 |
| 11 | VG9B416 | GFTFSNYDMN 353 | SISSSSSYIY 354 | DVGVTTDYYYYGMDV 355 | RASQSVASSYLA 356 | GASSRAT 357 | QQYGSSPPYT 358 |
| 12 | VG9B69 | GFTFSSYDIN 387 | SITSSSYYIY 388 | DLGVRGVDYYYYGLDV 389 | RASQSVSSSYLA 390 | GASSRAT 391 | QQYGSSPPYT 392 |
| 13 | VG9B415 | GFTFSNYDMN 421 | SISSSSSYIY 422 | DVGVTTDYYYYGMDV 423 | RASQSVASSYLA 424 | GASSRAT 425 | QQYGSSPPYT 426 |

TABLE 5-continued

AbM CDR Amino Acid Sequences

| # | Protein Name | HC AbM CDR1 | HC AbM CDR2 | HC AbM CDR3 | LC AbM CDR1 | LC AbM CDR2 | LC AbM CDR3 |
|---|---|---|---|---|---|---|---|
| 14 | VG9B104 | GFTFSVYSMN 455 | SIGSSSSYIF 456 | DHDYGGLDY 457 | RASQSVSSSYLA 458 | GPSNRAT 459 | QQYGRSPLT 460 |
| 15 | VG9B198 | GDSISSIYWS 489 | RIYTTDITN 490 | NGYSYGGFNY 491 | TGSSSNIGAGYDVH 492 | GDSYRPS 493 | QSYDSSLSVVV 494 |
| 16 | VG9B463 | GFTFSNYDMN 523 | SISSSSSYIY 524 | DVGVTTDYYYYGMDV 525 | SGSSSNIGSNTVN 526 | TNTQRPS 527 | AAWDDSLNAWV 528 |
| 17 | VG9B469 | GFTFSHYDMN 557 | SISSSSSYIF 558 | DRGVGDTSDYYSFGLDV 559 | RASQNVSSTYLA 560 | GACSRAT 561 | QQYGSSPPYT 562 |
| 18 | VG9B428 | GFTFSNYGMN 591 | YISSGSSYKY 592 | DPVVTEYYYYGMDV 593 | RASQGINSWLA 594 | AASSLQS 595 | QQANSFPWT 596 |
| 19 | VG9B430 | GFTFSSYDMN 625 | SISSSSSYIY 626 | DVGVTTDYYYYGMDV 627 | RASQSVASSYLA 628 | GASSRAT 629 | QQYGSSPPYT 630 |
| 20 | VG9B423 | GFTFSNYDMN 659 | SISSSSSYIY 660 | DVGVTTDYYYYGMDV 661 | RASQSVASSYLA 662 | GASSRAT 663 | QQYGSSPPYT 664 |
| 21 | VG9B98 | GFTFSSYSMY 693 | SIGSSSSYIF 694 | DGELGPFEY 695 | RASQSVSTSYLA 696 | GTSSRAT 697 | LQYGRSPLT 698 |
| 22 | VG9B73 | GFTFSNYDMN 727 | SISSSSSYIY 728 | EIGVTGTTYYQDYGMDV 729 | RASQSFSSNYLA 730 | GASSRAT 731 | QQYGSSPPFT 732 |
| 23 | VG9B133 | GFTFSNYDMN 761 | SISSSSSYIY 762 | DLGITGTTMDYYYGMDV 763 | RASQSVSSSYLA 764 | GASSRAT 765 | QQYGSSPPYT 766 |
| 24 | VG9B368 | GFTFNSYDMN 795 | SISSSSSYIY 796 | DRGIGGDYYSYAMDV 797 | RASQSVSSSYLA 798 | GASSRAT 799 | QQYGSSPPYT 800 |
| 25 | VG9B424 | GFTFSNYDMN 829 | SISSSSSYIY 830 | DVGVTTDYYYYGMDV 831 | RASQSVASSYLA 832 | GASSRAT 833 | QQYGSSPPYT 834 |
| 26 | VG9B427 | GFTFSNYDMN 863 | SISSSSSYIY 864 | DVGVTTDYYYYGMDV 865 | RASQSVASSYLA 866 | GASSRAT 867 | QQYGSSPPYT 868 |
| 27 | VG9B417 | GFTFSNYGMN 897 | YISSGSSYKY 898 | DPVVTEYYYYGMDV 899 | RASQGINSWLA 900 | AASSLQS 901 | QQANSFPWT 902 |
| 28 | VG9B58 | GGSIKSSYWT 931 | YMFYLGSTN 932 | ERPVLDAFDI 933 | RASQDITNYLA 934 | AASSLQG 935 | LQHDTYPYT 936 |
| 29 | VG9B419 | GFTFSNYDMN 965 | SISSSSSYIY 966 | DVGVTTDYYYYGMDV 967 | RASQSVASSYLA 968 | GASSRAT 969 | QQYGSSPPYT 970 |
| 30 | VG9B425 | GFTFSNYDMN 999 | SISSSSSYIY 1000 | DVGVTTDYYYYGMDV 1001 | RASQSVASSYLA 1002 | GASSRAT 1003 | QQYGSSPPYT 1004 |
| 31 | VG9B143 | GFTFSTYGMN 1033 | YISTSSYTIY 1034 | EGDWWYFDL 1035 | TGTSSDVGGYNYVS 1036 | EVSNRPS 1037 | SSYTSSSTLV 1038 |
| 32 | VG9B418 | GFTFSNYDMN 1067 | SISSSSSYIY 1068 | DVGVTTDYYYYGMDV 1069 | RASQSVASSYLA 1070 | GASSRAT 1071 | QQYGSSPPYT 1072 |
| 33 | VG9B472 | GFTFSHYDMN 1101 | SISSSSSYIF 1102 | DRGVGDTSDYYSFGLDV 1103 | RASQGIATYLA 1104 | AASTLQS 1105 | QKYNSAPPWT 1106 |
| 34 | VG9B421 | GFTFSNYGMN 1135 | YISSGSSYKY 1136 | DPVVTEYYYYGMDV 1137 | RASQGINSWLA 1138 | AASSLQS 1139 | QQANSFPWT 1140 |
| 35 | VG9B88 | GFTFSSYTMN 1169 | SISTSSSYID 1170 | DGDMVAPIKGSFDY 1171 | RSSQSLLNSDDGNTYLD 1172 | TLSYRAS 1173 | MQRIEFPIT 1174 |
| 36 | VG9B384 | GFSLSSSGMCVS 1203 | LIDWFDDKY 1204 | IRGTGAYYYGLDV 1205 | SGNELGDKYAS 1206 | QDNKRPS 1207 | QAWDSSKVV 1208 |
| 37 | VG9B413 | GFTFSNYDMN 1237 | SISSSSSYIY 1238 | DVGVTTDYYYYGMDV 1239 | RASQSVASSYLA 1240 | GASSRAT 1241 | QQYGSSPPYT 1242 |
| 38 | VG9B36 | GFTFSSYGMY 1271 | SISTGSSYIY 1272 | DKGLAVTGYIMDV 1273 | QASQDISNYLN 1274 | DASNLET 1275 | QQYDNLPMYT 1276 |

TABLE 5-continued

AbM CDR Amino Acid Sequences

| # | Protein Name | HC AbM CDR1 | HC AbM CDR2 | HC AbM CDR3 | LC AbM CDR1 | LC AbM CDR2 | LC AbM CDR3 |
|---|---|---|---|---|---|---|---|
| 39 | VG9B403 | GFTFSNYDMN 1305 | SISSSSSYIY 1306 | DVGVTTDYYYYGMDV 1307 | RASQSVASSYLA 1308 | GASSRAT 1309 | QQYGSSPPYT 1310 |
| 40 | VG9B191 | GFTFSRYSMN 1339 | SISSSSSYIY 1340 | DGPTVNWDYYFDL 1341 | SGSSSNIGNNYVS 1342 | DNNKRPS 1343 | GTWDSSLSTSVV 1344 |
| 41 | VG9B44 | GDSVSSNSAAWN 1373 | RTYYRSKWYND 1374 | ESGSYYTDGFDI 1375 | RASQGISSYLA 1376 | AASTLQS 1377 | QEFNSYPYT 1378 |
| 42 | VG9B67 | GFTFSSYTMN 1407 | SISSSSSYID 1408 | DGDILATIRGSFDY 1409 | RSSQSLLDSDAGNTYLD 1410 | TLSYRAS 1411 | MQRIEFPIT 1412 |
| 43 | VG9B402 | GFTFSNYGMN 1441 | YISSGSSYKY 1442 | DPVVTEYYYYGMDV 1443 | RASQGINSWLA 1444 | AASSLQS 1445 | QQANSFPWT 1446 |
| 44 | VG9B127 | GFTFGAYTMN 1475 | SISSSSSYID 1476 | DGDIVSTIRGSFDY 1477 | RSSQSLLDSDDGNTYLD 1478 | TLSYRAS 1479 | MQRIEFPIT 1480 |
| 45 | VG9B137 | GITFSSYSMD 1509 | SIGSSSSYIF 1510 | SYSWNYGGAFDI 1511 | RASQSVSSSYLA 1512 | GASSRAT 1513 | QQYGSSPPYT 1514 |
| 46 | VG9B33 | GFTFSSYNMN 1543 | SISTSSSYIY 1544 | DTSVTKYPDTFDI 1545 | RASQDINNYLA 1546 | GASTLQS 1547 | QKYNSAPFT 1548 |
| 47 | VG9B162 | GYTFTGDYMH 1577 | WINPNSGYTN 1578 | EGDAFDV 1579 | TGTSSDVGGYNYVS 1580 | EVSKRPS 1581 | NSYAGSNNFEV 1582 |
| 48 | VG9B152 | GFTFSSYSMI 1611 | SISSSSDYIY 1612 | DWELLGFDC 1613 | SGDKLGDKYAC 1614 | QHNKRPS 1615 | QAWDSTTVV 1616 |
| 49 | VG9B64 | GFSLSISGVSVG 1645 | LIYWNDDKR 1646 | SGQWLEGDAFDI 1647 | RSSESLVHSDGNTYLS 1648 | KISNRFS 1649 | MQATQFPLT 1650 |
| 50 | VG9B21 | GFSFSNYDMN 1679 | SISSSSHYIY 1680 | DRGVTTDYYYYALDV 1681 | RASQGIYNYLA 1682 | AASTLQS 1683 | QKYNRAPFT 1684 |
| 51 | VG9B128 | GFTFGTYGMH 1713 | VIWYNGSNKY 1714 | GGFGESFDS 1715 | RASQSVIDYLA 1716 | DASNRAT 1717 | QQRSNWPLT 1718 |
| 52 | VG9B66 | GFTFSTYTMN 1747 | SISSSSFYMD 1748 | DGDIVATIRGSFDY 1749 | RASQDITNFLA 1750 | TASTLQS 1751 | QKYNSAPFT 1752 |
| 53 | VG9B32 | GFTFSRYAMN 1781 | FISGTGYTVY 1782 | DQEPGFDY 1783 | RSGQSLVHSDGNTYLS 1784 | KISNRFS 1785 | MQATHFPFT 1786 |
| 54 | VG9B57 | GFTFSSHDMN 1815 | SISSSSSYIF 1816 | DLGVGVRDYYYYGMDV 1817 | RASQDITNYLA 1818 | AASSLQG 1819 | LQHDTYPYT 1820 |
| 55 | VG9B135 | GFSLTTYGVGVG 1849 | LIYWNDDKR 1850 | DYDFWSGYFDY 1851 | RASQSVSSSYLA 1852 | GASSRAT 1853 | QQYGSSPLT 1854 |
| 56 | VG9B60 | GYTFTGYYMH 1883 | RINPNSGVTH 1884 | GGSLVRGVISGLDY 1885 | RASQSFSGSYLA 1886 | GASSRAT 1887 | QQYGSSPPYT 1888 |
| 57 | VG9B409 | GYTLTSYYMH 1917 | IINPSGGSTS 1918 | GSYGWYFDL 1919 | RASQSVTSSYLA 1920 | GASSRAT 1921 | QQYGSSPPYT 1922 |
| 58 | VG9B411 | GFTFSNYDMN 1951 | SISSSSSYIY 1952 | DVGVTTDYYYYGMDV 1953 | RASQGINSWLA 1954 | AASTLQS 1955 | QQYNNWPRT 1956 |
| 59 | VG9B129 | GGTFSSYVIS 1985 | GILPILSTAN 1986 | AHDYYYGMDV 1987 | RASQSVSNNYLA 1988 | GASSRAT 1989 | QQYGSSPPYT 1990 |
| 60 | VG9B396 | GDSIRGYYWN 2019 | RIFTTGNTN 2020 | EKWDSSSSALYFDF 2021 | TGSSSNIGADYDVK 2022 | GNTDRPS 2023 | QSYDSRLTGYVV 2024 |
| 61 | VG9B470 | GFSLTTSGVGVG 2053 | LILWNDHTI 2054 | DKWELRDAFDI 2055 | RASQGISRYLA 2056 | VASTLQS 2057 | QQLISYPYT 2058 |
| 62 | VG9B111 | GFTFSTYSVN 2087 | SISSDSSYIF 2088 | DSVTGPFDY 2089 | QASQDISHYLN 2090 | DSYILET 2091 | QQYDNLPYT 2092 |
| 63 | VG9B169 | GGSITNYFWN 2121 | YIFYSGSTS 2122 | VGRWELRTAFDI 2123 | SGSSSNIGSNTVN 2124 | SNNQRPS 2125 | AAWDDSLNGPGV 2126 |

TABLE 5-continued

AbM CDR Amino Acid Sequences

| # | Protein Name | HC AbM CDR1 | HC AbM CDR2 | HC AbM CDR3 | LC AbM CDR1 | LC AbM CDR2 | LC AbM CDR3 |
|---|---|---|---|---|---|---|---|
| 64 | VG9B639 | GFTFTTYRMN 2155 | SISSSSIYIH 2156 | ERVYTVSFDY 2157 | QASQDISHYLN 2158 | DSYILET 2159 | QQYDNLPYT 2160 |
| 65 | VG9B201 | GFSLTTHGVGVG 2189 | LIYWNADKH 2190 | EGDWGHYFDF 2191 | SGSSSNIGNNDVS 2192 | DNNRRPS 2193 | ETWDSSLSAIWV 2194 |
| 66 | VG9B161 | GGSISSYFWS 2223 | YIFYSGSTN 2224 | VGRWELRGAFDI 2225 | SGSSSNIGSNTVN 2226 | SNNQRPS 2227 | AAWDDSLNSPGV 2228 |
| 67 | VG9B383 | SGSISSYYWN 2257 | RIYTIGNTN 2258 | EGYYDSSGSFFPGAFGI 2259 | TGTSNDVGSYNLVS 2260 | AGSKRPS 2261 | CSFAGATNVV 2262 |
| 68 | VG9B382 | GDSISGYYWN 2291 | RIFTTGNTN 2292 | ERWDSSSSALYFDY 2293 | TGSSSNIGADYDIK 2294 | GNSNRPS 2295 | QSYDSSMSGYVV 2296 |
| 69 | VG9B156 | NGSISGYFWN 2325 | YIFYSGSTN 2326 | LGKWELRTAFDI 2327 | SGTSNIGSDTVN 2328 | SNNQRPS 2329 | AAWDDSLNGPV 2330 |
| 70 | VG9B205 | NGSISGYFWN 2359 | YIFYSGSTN 2360 | LGKWELRTAFDI 2361 | SGDKLGDKYAC 2362 | QDSKRPS 2363 | QAWDSSTVV 2364 |
| 71 | VG9B86 | GDSISSSYWS 2393 | RFYSSGSTS 2394 | YSGSYWYFDL 2395 | RASQSVSSYLA 2396 | DTSNRAT 2397 | QQRSDWLLT 2398 |
| 72 | VG9B154 | GGSISYYFWN 2427 | YIYYSGSTN 2428 | EGKWELRTTFDI 2429 | SGSSSNIGSNTVN 2430 | SNNQRPS 2431 | AAWDDSLNGPV 2432 |
| 73 | VG9B159 | GGSISSYYWS 2461 | RFYTGGRNN 2462 | DMEYYYDRSGYSYWYFDL 2463 | GGNNIGSKSVH 2464 | DDSDRPS 2465 | QVWDSSSDHVV 2466 |
| 74 | VG9B465 | GGSITSYYWN 2495 | RIYTIGNTN 2496 | EGYYESDGSFFPGAFNI 2497 | TGTSNDVGSYNLVS 2498 | AGSKRPS 2499 | CSYAGTTNVV 2500 |
| 75 | VG9B194 | GYTFTGDYMH 2529 | WINPNSGYTN 2530 | ELDALDV 2531 | TGTSSDVGGYNYVS 2532 | EVSKRPS 2533 | NSYAGSNNFEV 2534 |
| 76 | VG9B182 | GDSINNHFWS 2563 | FVFYNGNTN 2564 | VGRWVLRTAFDI 2565 | SGSSSNIGSNTVN 2566 | SNNQRPS 2567 | AAWDDSLNGPGV 2568 |
| 77 | VG9B173 | GGSINNYFWS 2597 | YIYYSGSTN 2598 | EGKWELRSAFDI 2599 | SGSSSNIESNTVN 2600 | SNNQRPS 2601 | TAWDDSLNGPV 2602 |
| 78 | VG9B87 | GYTFTSEYIH 2631 | IINPSGGSTS 2632 | ERGYSYGSFDY 2633 | RASQGISSYLA 2634 | AASTLQS 2635 | QQFNSYSLT 2636 |
| 79 | VG9B208 | GGSISGYYWS 2665 | YIFYSGSIN 2666 | VGKWELRSSFDI 2667 | SGTSNIGNNDVS 2668 | DNNKRPS 2669 | GTWDSSLSVWV 2670 |
| 80 | VG9B372 | GGSISNGGFYWS 2699 | YINYSGSTY 2700 | DRNYEWNFDL 2701 | RASQSVSSYLA 2702 | DASNRAT 2703 | QQRSNWPLT 2704 |
| 81 | VG9B186 | GFSLTNIRMSVS 2733 | HIFSNDEKS 2734 | MRLPYGMDV 2735 | SGSTSNIGSNTVN 2736 | SNNQRPS 2737 | AAWDDSLNGPV 2738 |
| 82 | VG9B177 | GGSINNYFWS 2767 | YIFYSGSTN 2768 | VGKWELRTAFDI 2769 | TGTSSDVADYNYVS 2770 | EVSNRPS 2771 | CSYTSSFTVV 2772 |
| 83 | VG9B114 | GFTFSRYDMH 2801 | AIGSAGDTY 2802 | GKWELRDAFDI 2803 | RASQGIHSYLA 2804 | VASTLQS 2805 | QQLNSYPYT 2806 |
| 84 | VG9B147 | GGSISGYFWN 2835 | YIFYSGSTN 2836 | EGKWELRSTFDI 2837 | QGDSLRSYYAT 2838 | GENNRPS 2839 | NSRDTGDHHLV 2840 |
| 85 | VG9B65 | GGTFNIYAIN 2869 | GIIPFFGTAN 2870 | GGDSGYDWGFDY 2871 | RSSQSLVHSDGNTYLS 2872 | QISNRFS 2873 | MQATQFPLT 2874 |
| 86 | VG9B81 | GGSINTYYWS 2903 | RIYTSDNTN 2904 | YNWNYWYFDL 2905 | RASQGISSYLA 2906 | TASTLQS 2907 | QHLNSYPYT 2908 |
| 87 | VG9B203 | GDSIGHYYWN 2937 | RIYTSGSTN 2938 | SGGNFYWYFDL 2939 | SGSSSNIGNNYVS 2940 | DNNKRPS 2941 | GTWDSSLSAGV 2942 |
| 88 | VG9B380 | GGSISNYYWS 2971 | RIYPSGITS 2972 | IMGTKGAFDI 2973 | TGTSSDVGGYNYVS 2974 | EVSNRPS 2975 | SSYTSTSVV 2976 |

TABLE 5-continued

AbM CDR Amino Acid Sequences

| # | Protein Name | HC AbM CDR1 | HC AbM CDR2 | HC AbM CDR3 | LC AbM CDR1 | LC AbM CDR2 | LC AbM CDR3 |
|---|---|---|---|---|---|---|---|
| 89 | VG9B103 | GGTFSSYAIS 3005 | GIIPIFGTAT 3006 | GVGWGTDYYYGLDV 3007 | RSSQGLVHSDGNTYLS 3008 | KISNRFS 3009 | MQATHHPLT 3010 |
| 90 | VG9B462 | GGSISNYYWS 3039 | RIYSSGITN 3040 | IVGVKGAFAI 3041 | TGTSSDVGGYNYVS 3042 | EVSNRPS 3043 | SSYTSTSVV 3044 |
| 91 | VG9B461 | GGSISNYYWS 3073 | RIYSSGITN 3074 | IVGVKGAFAI 3075 | TGTSSDVGGYNYVS 3076 | EVSNRPS 3077 | SSYTSTSVV 3078 |
| 92 | VG9B106 | GYTFTGYYLH 3107 | WINPSSGDTD 3108 | ELGIGVFDY 3109 | KSSQSVLYSSNNKNYLG 3110 | WASTRES 3111 | QQYYSIPYT 3112 |
| 93 | VG9B115 | GFSLSTYGVGVG 3141 | LIYWNDDKR 3142 | ESDWSYYFDY 3143 | RASQSVSSYLA 3144 | DASNRAT 3145 | QQRSSWPWT 3146 |
| 94 | VG9B27 | GGTFSSYVIS 3175 | GILPILSTAN 3176 | AHDYYYGMDV 3177 | RSSQSLVHSDGNTYLS 3178 | KISNRFS 3179 | MQATHHPLT 3180 |
| 95 | VG9B458 | GGSISNYYWS 3209 | RIYSSGITN 3210 | IVGVKGAFAI 3211 | TGTSSDVGGYNYVS 3212 | EVSNRPS 3213 | SSYTSTSVV 3214 |
| 96 | VG9B131 | GFTFSSYDMN 3243 | YISSSSTAKY 3244 | EDIVVVTPILQH 3245 | RASQSVSNYLA 3246 | DASNRAT 3247 | QQRSNWT 3248 |
| 97 | VG9B163 | GFTFSNHGMS 3277 | SITRGGDTTY 3278 | GPLTVGYAMDY 3279 | SGNSSNIGHNYVS 3280 | DNNQRPS 3281 | GIWDSSLSIVV 3282 |
| 98 | VG9B454 | GGSISNYYWS 3311 | RIYSSGITN 3312 | IVGVKGAFAI 3313 | TGTSSDVGGYNYVS 3314 | EVSNRPS 3315 | SSYTSTSVV 3316 |
| 99 | VG9B439 | GGSISNYYWS 3345 | RIYSSGITN 3346 | IVGVKGAFAI 3347 | TGTSSDVGGYNYVS 3348 | EVSNRPS 3349 | SSYTSTSVV 3350 |
| 100 | VG9B68 | GGTFSTYAIS 3379 | GIIPIFGTAT 3380 | GVGWGSDYYYGLDV 3381 | RSSQSLVHSDGNTYLS 3382 | KISNRFS 3383 | IQATHHPLT 3384 |
| 101 | VG9B449 | GGSISNYYWS 3413 | RIYSSGITN 3414 | IVGVKGAFAI 3415 | TGTSSDVGGYNYVS 3416 | EVSNRPS 3417 | SSYTSTSVV 3418 |
| 102 | VG9B204 | YGSFSSFYWS 3447 | RIYTSGGTI 3448 | WLRAFDY 3449 | SGDKLGDKYAC 3450 | QDSKRPS 3451 | QAWDSSTVV 3452 |
| 103 | VG9B459 | GGSISNYYWS 3481 | RIYSSGITN 3482 | IVGVKGAFAI 3483 | TGTSSDVGGYNYVS 3484 | EVSNRPS 3485 | SSYTSTSVV 3486 |
| 104 | VG9B157 | GFTFSNHGMS 3515 | SITRGGDTTY 3516 | GPLTVGYAMDY 3517 | QGDSLRSYYAT 3518 | GENNRPS 3519 | NSRDTGDHHLV 3520 |
| 105 | VG9B453 | GGSISNYYWS 3549 | RIYSSGITN 3550 | IVGVKGAFAI 3551 | TGTSSDVGGYNYVS 3552 | EVSNRPS 3553 | SSYTSTSVV 3554 |
| 106 | VG9B443 | GGSISNYYWS 3583 | RIYSSGITN 3584 | IVGVKGAFAI 3585 | TGTSSDVGGYNYVS 3586 | EVSNRPS 3587 | SSYTSTSVV 3588 |
| 107 | VG9B455 | GGSISNYYWS 3617 | RIYSSGITN 3618 | IVGVKGAFAI 3619 | TGTSSDVGGYNYVS 3620 | EVSNRPS 3621 | SSYTSTSVV 3622 |
| 108 | VG9B466 | GGSISNYYWS 3651 | RIYSSGITN 3652 | IVGVKGAFAI 3653 | TGTSSDVGGYNYVS 3654 | EVSNRPS 3655 | SSYTSTSVV 3656 |
| 109 | VG9B450 | GGSISNYYWS 3685 | RIYSSGITN 3686 | IVGVKGAFAI 3687 | TGTSSDVGGYNYVS 3688 | EVSNRPS 3689 | SSYTSTSVV 3690 |
| 110 | VG9B438 | GGSISNYYWS 3719 | RIYSSGITN 3720 | IVGVKGAFAI 3721 | TGTSSDVGGYNYVS 3722 | EVSNRPS 3723 | SSYTSTSVV 3724 |
| 111 | VG9B464 | GGSISNYYWS 3753 | RIYSSGITN 3754 | IVGVKGAFAI 3755 | TGTSSDVGGYNYVS 3756 | EVSNRPS 3757 | SSYTSTSVV 3758 |
| 112 | VG9B437 | GGSISNYYWS 3787 | RIYSSGITN 3788 | IVGVKGAFAI 3789 | TGTSSDVGGYNYVS 3790 | EVSNRPS 3791 | SSYTSTSVV 3792 |
| 113 | VG9B457 | GGSISNYYWS 3821 | RIYSSGITN 3822 | IVGVKGAFAI 3823 | TGTSSDVGGYNYVS 3824 | EVSNRPS 3825 | SSYTSTSVV 3826 |

TABLE 5-continued

AbM CDR Amino Acid Sequences

| # | Protein Name | HC AbM CDR1 | HC AbM CDR2 | HC AbM CDR3 | LC AbM CDR1 | LC AbM CDR2 | LC AbM CDR3 |
|---|---|---|---|---|---|---|---|
| 114 | VG9B442 | GGSISNYYWS 3855 | RIYSSGITN 3856 | IVGVKGAFAI 3857 | TGTSSDVGGYNYVS 3858 | EVSNRPS 3859 | SSYTSTSVV 3860 |
| 115 | VG9B436 | GGSISNYYWS 3889 | RIYSSGITN 3890 | IVGVKGAFAI 3891 | TGTSSDVGGYNYVS 3892 | EVSNRPS 3893 | SSYTSTSVV 3894 |
| 116 | VG9B434 | GGSISNYYWS 3923 | RIYSSGITN 3924 | IVGVKGAFAI 3925 | TGTSSDVGGYNYVS 3926 | EVSNRPS 3927 | SSYTSTSVV 3928 |
| 117 | VG9B460 | GGSISNYYWS 3957 | RIYSSGITN 3958 | IVGVKGAFAI 3959 | TGTSSDVGGYNYVS 3960 | EVSNRPS 3961 | SSYTSTSVV 3962 |
| 118 | VG9B189 | GFTFSNHGMS 3991 | SITRGGDTTY 3992 | GPLTVGYAMDY 3993 | TGTSSDVGGYNYVS 3994 | EVSKRPS 3995 | NSYAGSNNFEV 3996 |
| 119 | VG9B452 | GGSISNYYWS 4025 | RIYSSGITN 4026 | IVGVKGAFAI 4027 | TGTSSDVGGYNYVS 4028 | EVSNRPS 4029 | SSYTSTSVV 4030 |
| 120 | VG9B53 | GGSISSYYWS 4059 | RIHTIGSIN 4060 | EGVGATNYYYGMAV 4061 | RSSQSLLHSNGYNYLD 4062 | LGSNRAS 4063 | MQALQTPYT 4064 |
| 121 | VG9B41 | GYSFTTYWMH 4093 | LIDPSDSETR 4094 | NRWLLG 4095 | RSSQSLVHSDGNTYLS 4096 | KISNRFS 4097 | VQTREFPLT 4098 |
| 122 | VG9B136 | GDSVSSNRAAWN 4127 | RTYYRSKWYNE 4128 | DLWELREACDI 4129 | RASQGISSYLA 4130 | VASTLQS 4131 | QQLNSYPFT 4132 |
| 123 | VG9B399 | GFTFSNYDMN 4161 | SISSSSSYIY 4162 | DVGVTTDYYYGMDV 4163 | RASQSVASSYLA 4164 | GASSRAT 4165 | QQYGSSPPYT 4166 |
| 124 | VG9B369 | GFSLSTIGVGVG 4195 | LIYWNDDKR 4196 | SHDWVHAFDI 4197 | QASQDISHYLN 4198 | DASNLDT 4199 | QQYDNFPLT 4200 |
| 125 | VG9B144 | GYTFTGYYMH 4229 | WINPNSGATN 4230 | EDDAFDV 4231 | QGDNLRNYYAT 4232 | GKNNRPS 4233 | NSRDSSGNHVV 4234 |
| 126 | VG9B410 | GFTFSNYGMN 4263 | YISSGSSYKY 4264 | DPVVTEYYYGMDV 4265 | RASQGINSWLA 4266 | AASSLQS 4267 | QQANSFPWT 4268 |
| 127 | VG9B386 | GFTFSSYSMI 4297 | SIGSSSTYIY 4298 | DGETGGFDY 4299 | RASQSISRSYLA 4300 | GPSNRAT 4301 | QQYGSLPLT 4302 |
| 128 | VG9B125 | GFTFSSYDMN 4331 | YISSSSTAKY 4332 | EDIVVVTPILQH 4333 | RASQSVSKDLA 4334 | DASNRAT 4335 | QQRINWPLFT 4336 |
| 129 | VG9B112 | GDSVSSNSAAWN 4365 | GTYYRSKWFNN 4366 | GEWGLRDAFDI 4367 | RASQGIHSYLA 4368 | VASTLQS 4369 | QQLNSYPWT 4370 |
| 130 | VG9B371 | RFTLSSYDMN 4399 | SISSSSSYIY 4400 | DRGVGGTDYYYYGLDV 4401 | RASQSVSSSYLA 4402 | GASSRAT 4403 | QQYGSSPPYT 4404 |
| 131 | VG9B387 | GFTFTGYYLQ 4433 | WINPNSGYTD 4434 | LDDAFDV 4435 | QGDSLRNYYAI 4436 | GKNNRPS 4437 | NSRDSSGNHWV 4438 |
| 132 | VG9B47 | GGSFSNYAIS 4467 | GIIPFFGTPD 4468 | GGGYGDYDYYYGINV 4469 | RSSQSLVHSDGNTYLS 4470 | KISNRFS 4471 | MQAKEFPLT 4472 |
| 133 | VG9B379 | GYTFTGDYIH 4501 | WINPNSGGTN 4502 | EGGVAPAAPDAFDI 4503 | QGDSLRSYYAR 4504 | GKNNRPS 4505 | NSRDSSGNHRV 4506 |
| 134 | VG9B447 | GGSISNYYWS 4535 | RIYSSGITN 4536 | IVGVKGAFAI 4537 | TGTSSDVGGYNYVS 4538 | EVSNRPS 4539 | SSYTSTSVV 4540 |
| 135 | VG9B392 | GYTFTGYYIH 4569 | WINPNSGYTN 4570 | EDDAFDI 4571 | QGDSLRSYYAR 4572 | GKNNRPS 4573 | NSRDNSGNHVV 4574 |
| 136 | VG9B96 | GGTFSNYAIS 4603 | GIIPIFSAGT 4604 | NSGTYYDYYYGMDV 4605 | RSSQSLVHSDGNTYLS 4606 | KIFNRLS 4607 | MQAKQFPLT 4608 |
| 137 | VG9B77 | GGTFSSYAIS 4637 | GIIPFFGTAD 4638 | ATVTTDYYYGMDV 4639 | RSSQSLVHSDGNTYLS 4640 | EISNRFT 4641 | MQARQFPLT 4642 |

TABLE 6

Contact CDR Amino Acid Sequences

| # | Protein Name | HC Contact CDR1 | HC Contact CDR2 | HC Contact CDR3 | LC Contact CDR1 | LC Contact CDR2 | LC Contact CDR3 |
|---|---|---|---|---|---|---|---|
| 1 | VG9B54 | SSYSLT 19 | WVSSISSSSSYIF 20 | ATDGELGPFD 21 | SSSYLAWF 22 | RLIYGASSRA 23 | QQYGRSPL 24 |
| 2 | VG9B121 | SDYAMD 53 | WISSISSTSNYIF 54 | ANSYNWNYGGAFD 55 | SSSYFAWY 56 | LLIYGASSRA 57 | QQYGRSPL 58 |
| 3 | VG9B429 | SNYDMN 87 | WVSSISSSSSYIY 88 | ARDVGVTTDYYYYGMD 89 | NSWLAWY 90 | LLIYAASSLQ 91 | QQANSFPW 92 |
| 4 | VG9B370 | SSYDMN 121 | WVSSISSSSSYIY 122 | ARDRGVGGTDYYYYGLD 123 | SSSYLAWY 124 | LLIYGASSRA 125 | QQYGSSPPY 126 |
| 5 | VG9B80 | STYSMN 155 | WVSSISSSSSYIF 156 | AKDGELGVFD 157 | SSSYLAWY 158 | VLIYGPSGRA 159 | QQFGRSPL 160 |
| 6 | VG9B414 | SNYDMN 189 | WVSSISSSSSYIY 190 | ARDVGVTTDYYYYGMD 191 | NSWLAWY 192 | LLIYAASSLQ 193 | QQANSFPW 194 |
| 7 | VG9B195 | SPYTMN 223 | WVSSISSSSSYMY 224 | ARDGDLVGPTYYFD 225 | DKYACWY 226 | LVIYQHNKRP 227 | QAWDSTTV 228 |
| 8 | VG9B140 | RSYDMN 257 | WVSSISTSSGYIY 258 | ARDRGIAVAGDYYYGMD 259 | SSSYLAWY 260 | LLIYGASSRA 261 | QQYGSSPPY 262 |
| 9 | VG9B426 | SNYDMN 291 | WVSSISSSSSYIY 292 | ARDVGVTTDYYYYGMD 293 | ASSYLAWY 294 | LLIYGASSRA 295 | QQYGSSPPY 296 |
| 10 | VG9B46 | SINSMN 325 | WVSSISSTSDYIF 326 | VRDDVFGAFD 327 | SRSYLGWY 328 | LLIFGSSSRA 329 | QQYSRSPL 330 |
| 11 | VG9B416 | SNYDMN 359 | WVSSISSSSSYIY 360 | ARDVGVTTDYYYYGMD 361 | ASSYLAWY 362 | LLIYGASSRA 363 | QQYGSSPPY 364 |
| 12 | VG9B69 | SSYDIN 393 | WVSSITSSSYYIY 394 | ARDLGVRGVDYYYYGLD 395 | SSSYLAWY 396 | LLIYGASSRA 397 | QQYGSSPPY 398 |
| 13 | VG9B415 | SNYDMN 427 | WVSSISSSSSYIY 428 | ARDVGVTTDYYYYGMD 429 | ASSYLAWY 430 | LLIYGASSRA 431 | QQYGSSPPY 432 |
| 14 | VG9B104 | SVYSMN 461 | WVSSIGSSSSYIF 462 | GRDHDYGGLD 463 | SSSYLAWY 464 | LLIYGPSNRA 465 | QQYGRSPL 466 |
| 15 | VG9B198 | SSIYWS 495 | WIGRIYTTDITN 496 | AKNGYSYGGFN 497 | IGAGYDVHWY 498 | LLIYGDSYRP 499 | QSYDSSLSVV 500 |
| 16 | VG9B463 | SNYDMN 529 | WVSSISSSSSYIY 530 | ARDVGVTTDYYYYGMD 531 | IGSNTVNWY 532 | LLIYTNTQRP 533 | AAWDDSLNAW 534 |
| 17 | VG9B469 | SHYDMN 563 | WVSSISSSSSYIF 564 | ARDRGVGDTSDYYSFGLD 565 | SSTYLAWY 566 | LLIYGACSRA 567 | QQYGSSPPY 568 |
| 18 | VG9B428 | SNYGMN 597 | WVSYISSGSSYKY 598 | ARDPVVTEYYYYGMD 599 | NSWLAWY 600 | LLIYAASSLQ 601 | QQANSFPW 602 |
| 19 | VG9B430 | SSYDMN 631 | WVSSISSSSSYIY 632 | ARDVGVTTDYYYYGMD 633 | ASSYLAWY 634 | LLIYGASSRA 635 | QQYGSSPPY 636 |
| 20 | VG9B423 | SNYDMN 665 | WVSSISSSSSYIY 666 | ARDVGVTTDYYYYGMD 667 | ASSYLAWY 668 | LLIYGASSRA 669 | QQYGSSPPY 670 |
| 21 | VG9B98 | SSYSMY 699 | WVSSIGSSSTYIF 700 | ARDGELGPFE 701 | STSYLAWF 702 | LLIFGTSSRA 703 | LQYGRSPL 704 |
| 22 | VG9B73 | SNYDMN 733 | WVSSISSSSSYIY 734 | AREIGVTGITYYQDYGMD 735 | SSNYLAWY 736 | LLIYGASSRA 737 | QQYGSSPPF 738 |
| 23 | VG9B133 | SNYDMN 767 | WVSSISSSSSYIY 768 | ARDLGITGTTMDYYYGMD 769 | SSSYLAWY 770 | LLIYGASSRA 771 | QQYGSSPPY 772 |
| 24 | VG9B368 | NSYDMN 801 | WVSSISSSSSYIY 802 | ARDRGIGGDYYSYAMD 803 | SSSYLAWY 804 | LLIYGASSRA 805 | QQYGSSPPY 806 |
| 25 | VG9B424 | SNYDMN 835 | WVSSISSSSSYIY 836 | ARDVGVTTDYYYYGMD 837 | ASSYLAWY 838 | LLIYGASSRA 839 | QQYGSSPPY 840 |

TABLE 6-continued

Contact CDR Amino Acid Sequences

| # | Protein Name | HC Contact CDR1 | HC Contact CDR2 | HC Contact CDR3 | LC Contact CDR1 | LC Contact CDR2 | LC Contact CDR3 |
|---|---|---|---|---|---|---|---|
| 26 | VG9B427 | SNYDMN 869 | WVSSISSSSSYIY 870 | ARDVGVTTDYYYYGMD 871 | ASSYLAWY 872 | LLIYGASSRA 873 | QQYGSSPPY 874 |
| 27 | VG9B417 | SNYGMN 903 | WVSYISSGSSYKY 904 | ARDPVVTEYYYYGMD 905 | NSWLAWY 906 | LLIYAASSLQ 907 | QQANSFPW 908 |
| 28 | VG9B58 | KSSYWT 937 | WIGYMFYLGSTN 938 | SRERPVLDAFD 939 | TNYLAWF 940 | RLIYAASSLQ 941 | LQHDTYPY 942 |
| 29 | VG9B419 | SNYDMN 971 | WVSSISSSSSYIY 972 | ARDVGVTTDYYYYGMD 973 | ASSYLAWY 974 | LLIYGASSRA 975 | QQYGSSPPY 976 |
| 30 | VG9B425 | SNYDMN 1005 | WVSSISSSSSYIY 1006 | ARDVGVTTDYYYYGMD 1007 | ASSYLAWY 1008 | LLIYGASSRA 1009 | QQYGSSPPY 1010 |
| 31 | VG9B143 | STYGMN 1039 | WISYISTSSYTIY 1040 | AREGDWWYFD 1041 | VGGYNYVSWY 1042 | LMIYEVSNRP 1043 | SSYTSSSTL 1044 |
| 32 | VG9B418 | SNYDMN 1073 | WVSSISSSSSYIY 1074 | ARDVGVTTDYYYYGMD 1075 | ASSYLAWY 1076 | LLIYGASSRA 1077 | QQYGSSPPY 1078 |
| 33 | VG9B472 | SHYDMN 1107 | WVSSISSSSSYIF 1108 | ARDRGVGDTSDYYSFGLD 1109 | ATYLAWY 1110 | LLIYAASTLQ 1111 | QKYNSAPPW 1112 |
| 34 | VG9B421 | SNYGMN 1141 | WVSYISSGSSYKY 1142 | ARDPVVTEYYYYGMD 1143 | NSWLAWY 1144 | LLIYAASSLQ 1145 | QQANSFPW 1146 |
| 35 | VG9B88 | SSYTMN 1175 | WVSSISTSSSYID 1176 | ARDGDMVAPIKGSFD 1177 | LNSDDGNTYLDWY 1178 | LLIYTLSYRA 1179 | MQRIEFPI 1180 |
| 36 | VG9B384 | SSSGMCVS 1209 | WLTLIDWFDDKY 1210 | ARIRGTGAYYYGLD 1211 | DKYASWY 1212 | LVIYQDNKRP 1213 | QAWDSSKV 1214 |
| 37 | VG9B413 | SNYDMN 1243 | WVSSISSSSSYIY 1244 | ARDVGVTTDYYYYGMD 1245 | ASSYLAWY 1246 | LLIYGASSRA 1247 | QQYGSSPPY 1248 |
| 38 | VG9B36 | SSYGMY 1277 | WVSSISTGSSYIY 1278 | ARDKGLAVTGYIMD 1279 | SNYLNWY 1280 | LLIYDASNLE 1281 | QQYDNLPMY 1282 |
| 39 | VG9B403 | SNYDMN 1311 | WVSSISSSSSYIY 1312 | ARDVGVTTDYYYYGMD 1313 | ASSYLAWY 1314 | LLIYGASSRA 1315 | QQYGSSPPY 1316 |
| 40 | VG9B191 | SRYSMN 1345 | GVSSISSSSSYIY 1346 | ARDGPTVNWDYYFD 1347 | IGNNYVSWY 1348 | LLIYDNNKRP 1349 | GTWDSSLSTSV 1350 |
| 41 | VG9B44 | SSNSAAWN 1379 | WLGRTYYRSKWYND 1380 | ARESGSYYTDGFD 1381 | SSYLAWY 1382 | LLIYAASTLQ 1383 | QEFNSYPY 1384 |
| 42 | VG9B67 | SSYTMN 1413 | WVSSISSSSSYID 1414 | ARDGDILATIRGSFD 1415 | LDSDAGNTYLDWY 1416 | LLIYTLSYRA 1417 | MQRIEFPI 1418 |
| 43 | VG9B402 | SNYGMN 1447 | WVSYISSGSSYKY 1448 | ARDPVVTEYYYYGMD 1449 | NSWLAWY 1450 | LLIYAASSLQ 1451 | QQANSFPW 1452 |
| 44 | VG9B127 | GAYTMN 1481 | WVSSISSSSSYID 1482 | ARDGDIVSTIRGSFD 1483 | LDSDDGNTYLDWY 1484 | LLIYTLSYRA 1485 | MQRIEFPI 1486 |
| 45 | VG9B137 | SSYSMD 1515 | WVSSIGSSSSYIF 1516 | ATSYSWNYGGAFD 1517 | SSSYLAWY 1518 | LLIYGASSRA 1519 | QQYGSSPPY 1520 |
| 46 | VG9B33 | SSYNMN 1549 | WVSSISTSSSYIY 1550 | ARDTSVTKYPDTFD 1551 | NNYLAWF 1552 | LLIYGASTLQ 1553 | QKYNSAPF 1554 |
| 47 | VG9B162 | TGDYMH 1583 | WMGWINPNSGYTN 1584 | AREGDAFD 1585 | VGGYNYVSWY 1586 | LMIYEVSKRP 1587 | NSYAGSNNFE 1588 |
| 48 | VG9B152 | SSYSMI 1617 | WVSSISSSSDYIY 1618 | ARDWELLGFD 1619 | DKYACWY 1620 | LVIYQHNKRP 1621 | QAWDSTTV 1622 |
| 49 | VG9B64 | SISGVSVG 1651 | WLALIYWNDDKR 1652 | VHSGQWLEGDAFD 1653 | VHSDGNTYLSWL 1654 | LLIYKISNRF 1655 | MQATQFPL 1656 |
| 50 | VG9B21 | SNYDMN 1685 | WVSSISSSHYIY 1686 | ARDRGVTTDYYYYALD 1687 | YNYLAWY 1688 | LLIYAASTLQ 1689 | QKYNRAPF 1690 |

TABLE 6-continued

Contact CDR Amino Acid Sequences

| # | Protein Name | HC Contact CDR1 | HC Contact CDR2 | HC Contact CDR3 | LC Contact CDR1 | LC Contact CDR2 | LC Contact CDR3 |
|---|---|---|---|---|---|---|---|
| 51 | VG9B128 | GTYGMH 1719 | WVAVIWYNGSNKY 1720 | ARGGFGESFD 1721 | IDYLAWF 1722 | LLIYDASNRA 1723 | QQRSNWPL 1724 |
| 52 | VG9B66 | STYTMN 1753 | WVSSISSSSFYMD 1754 | ARDGDIVATIRGSFD 1755 | TNFLAWY 1756 | LLIYTASTLQ 1757 | QKYNSAPF 1758 |
| 53 | VG9B32 | SRYAMN 1787 | WVSFISGTGYTVY 1788 | ARDQEPGFD 1789 | VHSDGNTYLSWL 1790 | LLIYKISNRF 1791 | MQATHFPF 1792 |
| 54 | VG9B57 | SSHDMN 1821 | WVSSISSSSYIF 1822 | ARDLGVGVRDYYYYGMD 1823 | TNYLAWF 1824 | RLIYAASSLQ 1825 | LQHDTYPY 1826 |
| 55 | VG9B135 | TTYGVGVG 1855 | WLALIYWNDDKR 1856 | AHDYDFWSGYFD 1857 | SSSYLAWY 1858 | LLIYGASSRA 1859 | QQYGSSPL 1860 |
| 56 | VG9B60 | TGYYMH 1889 | WMGRINPNSGVTH 1890 | ARGGSLVRGVISGLD 1891 | SGSYLAWY 1892 | LLIYGASSRA 1893 | QQYGSSPPY 1894 |
| 57 | VG9B409 | TSYYMH 1923 | WMGIINPSGGSTS 1924 | ARGSYGWYFD 1925 | TSSYLAWY 1926 | LLIYGASSRA 1927 | QQYGSSPPY 1928 |
| 58 | VG9B411 | SNYDMN 1957 | WVSSISSSSSYIY 1958 | ARDVGVTTDYYYYGMD 1959 | NSWLAWY 1960 | LLIYAASTLQ 1961 | QQYNNWPR 1962 |
| 59 | VG9B129 | SSYCIS 1991 | WMGGILPILSTAN 1992 | ARAHDYYYGMD 1993 | SNNYLAWY 1994 | LLIYGASSRA 1995 | QQYGSSPPY 1996 |
| 60 | VG9B396 | RGYYWN 2025 | WIGRIFTTGNTN 2026 | AREKWDSSSSALYFD 2027 | IGADYDVKWY 2028 | LLIYGNTDRP 2029 | QSYDSRLTGYV 2030 |
| 61 | VG9B470 | TTSGVGVG 2059 | WLALILWNDHTI 2060 | ARDKWELRDAFD 2061 | SRYLAWY 2062 | LLIYVASTLQ 2063 | QQLISYPY 2064 |
| 62 | VG9B111 | STYSVN 2093 | WVSSISSDSSYIF 2094 | ARDSVTGPFD 2095 | SHYLNWY 2096 | LLIYDSYILE 2097 | QQYDNLPY 2098 |
| 63 | VG9B169 | TNYFWN 2127 | WIGYIFYSGSTS 2128 | ARVGRWELRTAFD 2129 | IGSNTVNWY 2130 | LLIYSNNQRP 2131 | AAWDDSLNGPG 2132 |
| 64 | VG9B639 | TTYRMN 2161 | WVSSISSSSIYIH 2162 | ARERVYTVSFD 2163 | SHYLNWY 2164 | LLIYDSYILE 2165 | QQYDNLPY 2166 |
| 65 | VG9B201 | TTHGVGVG 2195 | WLALIYWNADKH 2196 | AHEGDWGHYFD 2197 | IGNNDVSWY 2198 | LLIYDNNRRP 2199 | ETWDSSLSAIW 2200 |
| 66 | VG9B161 | SSYFWS 2229 | WIGYIFYSGSTN 2230 | ARVGRWELRGAFD 2231 | IGSNTVNWY 2232 | LLIYSNNQRP 2233 | AAWDDSLNSPG 2234 |
| 67 | VG9B383 | SSYYWN 2263 | WVGRIYTIGNTN 2264 | AREGYYDSSGSFFPGAFG 2265 | VGSYNLVSWY 2266 | LMIYAGSKRP 2267 | CSFAGATNV 2268 |
| 68 | VG9B382 | SGYYWN 2297 | WIGRIFTTGNTN 2298 | ARERWDSSSSALYFD 2299 | IGADYDIKWY 2300 | LLIYGNSNRP 2301 | QSYDSSMSGYV 2302 |
| 69 | VG9B156 | SGYFWN 2331 | WIGYIFYSGSTN 2332 | AKLGKWELRTAFD 2333 | IGSDTVNWY 2334 | LLIYSNNQRP 2335 | AAWDDSLNGP 2336 |
| 70 | VG9B205 | SGYFWN 2365 | WIGYIFYSGSTN 2366 | AKLGKWELRTAFD 2367 | DKYACWY 2368 | LVIYQDSKRP 2369 | QAWDSSTV 2370 |
| 71 | VG9B86 | SSSYWS 2399 | CIGRFYSSGSTS 2400 | ARYSGSYWYFD 2401 | SSYLAWY 2402 | LLIYDTSNRA 2403 | QQRSDWLL 2404 |
| 72 | VG9B154 | SYYFWN 2433 | WIGYIYYSGSTN 2434 | AREGKWELRTTFD 2435 | IGSNTVNWY 2436 | LLIYSNNQRP 2437 | AAWDDSLNGP 2438 |
| 73 | VG9B159 | SSYYWS 2467 | WIGRFYTGGRNN 2468 | ARDMEYYYDRSGYSYWYFD 2469 | SKSVHWY 2470 | LVVYDDSDRP 2471 | QVWDSSSDHV 2472 |
| 74 | VG9B465 | TSYYWN 2501 | WIGRIYTIGNTN 2502 | AREGYYESDGSFFPGAFN 2503 | VGSYNLVSWY 2504 | LMIYAGSKRP 2505 | CSYAGTTNV 2506 |
| 75 | VG9B194 | TGDYMH 2535 | WMGWINPNSGYTN 2536 | TRELDALD 2537 | VGGYNYVSWY 2538 | LMIYEVSKRP 2539 | NSYAGSNNFE 2540 |

TABLE 6-continued

Contact CDR Amino Acid Sequences

| # | Protein Name | HC Contact CDR1 | HC Contact CDR2 | HC Contact CDR3 | LC Contact CDR1 | LC Contact CDR2 | LC Contact CDR3 |
|---|---|---|---|---|---|---|---|
| 76 | VG9B182 | NNHFWS 2569 | WIGFVFYNGNTN 2570 | ARVGRWVLRTAFD 2571 | IGSNTVNWY 2572 | LLIYSNNQRP 2573 | AAWDDSLNGPG 2574 |
| 77 | VG9B173 | NNYFWS 2603 | WIGYIYYSGSTN 2604 | AREGKWELRSAFD 2605 | IESNTVNWY 2606 | LLIYSNNQRP 2607 | TAWDDSLNGP 2608 |
| 78 | VG9B87 | TSEYIH 2637 | WMGIINPSGGSTS 2638 | ARERGYSYGSFD 2639 | SSYLAWY 2640 | LLIYAASTLQ 2641 | QQFNSYSL 2642 |
| 79 | VG9B208 | SGYYWS 2671 | LIGYIFYSGSIN 2672 | ARVGKWELRSSFD 2673 | IGNNDVSWY 2674 | LLIYDNNKRP 2675 | GTWDSSLSVW 2676 |
| 80 | VG9B372 | SNGGFYWS 2705 | WLGYINYSGSTY 2706 | ARDRNYEWNFD 2707 | SSYLAWY 2708 | LLVYDASNRA 2709 | QQRSNWPL 2710 |
| 81 | VG9B186 | TNIRMSVS 2739 | WLAHIFSNDEKS 2740 | ARMRLPYGMD 2741 | IGSNTVNWY 2742 | LLIYSNNQRP 2743 | AAWDDSLNGP 2744 |
| 82 | VG9B177 | NNYFWS 2773 | WIGYIFYSGSTN 2774 | ARVGKWELRTAFD 2775 | VADYNYVSWY 2776 | LMIYEVSNRP 2777 | CSYTSSFTV 2778 |
| 83 | VG9B114 | SRYDMH 2807 | WVSAIGSAGDTY 2808 | ARGKWELRDAFD 2809 | HSYLAWY 2810 | LLIYVASTLQ 2811 | QQLNSYPY 2812 |
| 84 | VG9B147 | SGYFWN 2841 | WIGYIFYSGSTN 2842 | AREGKWELRSTFD 2843 | SYYATWY 2844 | LVIYGENNRP 2845 | NSRDTGDHHL 2846 |
| 85 | VG9B65 | NIYAIN 2875 | WMGGIIPFFGTAN 2876 | ARGGDSGYDWGFD 2877 | VHSDGNTYLSWL 2878 | LLIYQISNRF 2879 | MQATQFPL 2880 |
| 86 | VG9B81 | NTYYWS 2909 | LIGRIYTSDNTN 2910 | ARYNWNYWYFD 2911 | SSYLAWY 2912 | LLIYTASTLQ 2913 | QHLNSYPY 2914 |
| 87 | VG9B203 | GHYYWN 2943 | WIGRIYTSGSTN 2944 | ARSGGNFYWYFD 2945 | IGNNYVSWY 2946 | LLIYDNNKRP 2947 | GTWDSSLSAG 2948 |
| 88 | VG9B380 | SNYYWS 2977 | WIGRIYPSGITS 2978 | AGIMGTKGAFD 2979 | VGGYNYVSWY 2980 | LLIYEVSNRP 2981 | SSYTSTSV 2982 |
| 89 | VG9B103 | SSYAIS 3011 | WMGGIIPIFGTAT 3012 | ARGVGWGTDYYYGLD 3013 | VHSDGNTYLSWL 3014 | LLIYKISNRF 3015 | MQATHHPL 3016 |
| 90 | VG9B462 | SNYYWS 3045 | WIGRIYSSGITN 3046 | AGIVGVKGAFA 3047 | VGGYNYVSWY 3048 | LMIYEVSNRP 3049 | SSYTSTSV 3050 |
| 91 | VG9B461 | SNYYWS 3079 | WIGRIYSSGITN 3080 | AGIVGVKGAFA 3081 | VGGYNYVSWY 3082 | LMIYEVSNRP 3083 | SSYTSTSV 3084 |
| 92 | VG9B106 | TGYYLH 3113 | WVGWINPSSGDTD 3114 | ANELGIGVFD 3115 | LYSSNNKNYLGWY 3116 | LLIYWASTRE 3117 | QQYYSIPY 3118 |
| 93 | VG9B115 | STYGVGVG 3147 | WLALIYWNDDKR 3148 | SHESDWSYYFD 3149 | SSYLAWY 3150 | LLIYDASNRA 3151 | QQRSSWPW 3152 |
| 94 | VG9B27 | SSYVIS 3181 | WMGGILPILSTAN 3182 | ARAHDYYYGMD 3183 | VHSDGNTYLSWL 3184 | LLVYKISNRF 3185 | MQATHHPL 3186 |
| 95 | VG9B458 | SNYYWS 3215 | WIGRIYSSGITN 3216 | AGIVGVKGAFA 3217 | VGGYNYVSWY 3218 | LMIYEVSNRP 3219 | SSYTSTSV 3220 |
| 96 | VG9B131 | SSYDMN 3249 | WVSYISSSSTAKY 3250 | AREDIVVVTPILQ 3251 | SNYLAWY 3252 | LLIYDASNRA 3253 | QQRSNW 3254 |
| 97 | VG9B163 | SNHGMS 3283 | WVASITRGGDTTY 3284 | TRGPLTVGYAMD 3285 | IGHNYVSWY 3286 | LLIYDNNQRP 3287 | GIWDSSLSIV 3288 |
| 98 | VG9B454 | SNYYWS 3317 | WIGRIYSSGITN 3318 | AGIVGVKGAFA 3319 | VGGYNYVSWY 3320 | LMIYEVSNRP 3321 | SSYTSTSV 3322 |
| 99 | VG9B439 | SNYYWS 3351 | WIGRIYSSGITN 3352 | AGIVGVKGAFA 3353 | VGGYNYVSWY 3354 | LMIYEVSNRP 3355 | SSYTSTSV 3356 |
| 100 | VG9B68 | STYAIS 3385 | WMGGIIPIFGTAT 3386 | ARGVGWGSDYYYGLD 3387 | VHSDGNTYLSWL 3388 | LLIYKISNRF 3389 | IQATHHPL 3390 |

TABLE 6-continued

Contact CDR Amino Acid Sequences

| # | Protein Name | HC Contact CDR1 | HC Contact CDR2 | HC Contact CDR3 | LC Contact CDR1 | LC Contact CDR2 | LC Contact CDR3 |
|---|---|---|---|---|---|---|---|
| 101 | VG9B449 | SNYYWS 3419 | WIGRIYSSGITN 3420 | AGIVGVKGAFA 3421 | VGGYNYVSWY 3422 | LMIYEVSNRP 3423 | SSYTSTSV 3424 |
| 102 | VG9B204 | SSFYWS 3453 | WIGRIYTSGGTI 3454 | ARWLRAFD 3455 | DKYACWY 3456 | LVIYQDSKRP 3457 | QAWDSSTV 3458 |
| 103 | VG9B459 | SNYYWS 3487 | WIGRIYSSGITN 3488 | AGIVGVKGAFA 3489 | VGGYNYVSWY 3490 | LMIYEVSNRP 3491 | SSYTSTSV 3492 |
| 104 | VG9B157 | SNHGMS 3521 | WVASITRGGDTTY 3522 | TRGPLTVGYAMD 3523 | SYYATWY 3524 | LVIYGENNRP 3525 | NSRDTGDHHL 3526 |
| 105 | VG9B453 | SNYYWS 3555 | WIGRIYSSGITN 3556 | AGIVGVKGAFA 3557 | VGGYNYVSWY 3558 | LMIYEVSNRP 3559 | SSYTSTSV 3560 |
| 106 | VG9B443 | SNYYWS 3589 | WIGRIYSSGITN 3590 | AGIVGVKGAFA 3591 | VGGYNYVSWY 3592 | LMIYEVSNRP 3593 | SSYTSTSV 3594 |
| 107 | VG9B455 | SNYYWS 3623 | WIGRIYSSGITN 3624 | AGIVGVKGAFA 3625 | VGGYNYVSWY 3626 | LMIYEVSNRP 3627 | SSYTSTSV 3628 |
| 108 | VG9B466 | SNYYWS 3657 | WIGRIYSSGITN 3658 | AGIVGVKGAFA 3659 | VGGYNYVSWY 3660 | LMIYEVSNRP 3661 | SSYTSTSV 3662 |
| 109 | VG9B450 | SNYYWS 3691 | WIGRIYSSGITN 3692 | AGIVGVKGAFA 3693 | VGGYNYVSWY 3694 | LMIYEVSNRP 3695 | SSYTSTSV 3696 |
| 110 | VG9B438 | SNYYWS 3725 | WIGRIYSSGITN 3726 | AGIVGVKGAFA 3727 | VGGYNYVSWY 3728 | LMIYEVSNRP 3729 | SSYTSTSV 3730 |
| 111 | VG9B464 | SNYYWS 3759 | WIGRIYSSGITN 3760 | AGIVGVKGAFA 3761 | VGGYNYVSWY 3762 | LMIYEVSNRP 3763 | SSYTSTSV 3764 |
| 112 | VG9B437 | SNYYWS 3793 | WIGRIYSSGITN 3794 | AGIVGVKGAFA 3795 | VGGYNYVSWY 3796 | LMIYEVSNRP 3797 | SSYTSTSV 3798 |
| 113 | VG9B457 | SNYYWS 3827 | WIGRIYSSGITN 3828 | AGIVGVKGAFA 3829 | VGGYNYVSWY 3830 | LMIYEVSNRP 3831 | SSYTSTSV 3832 |
| 114 | VG9B442 | SNYYWS 3861 | WIGRIYSSGITN 3862 | AGIVGVKGAFA 3863 | VGGYNYVSWY 3864 | LMIYEVSNRP 3865 | SSYTSTSV 3866 |
| 115 | VG9B436 | SNYYWS 3895 | WIGRIYSSGITN 3896 | AGIVGVKGAFA 3897 | VGGYNYVSWY 3898 | LMIYEVSNRP 3899 | SSYTSTSV 3900 |
| 116 | VG9B434 | SNYYWS 3929 | WIGRIYSSGITN 3930 | AGIVGVKGAFA 3931 | VGGYNYVSWY 3932 | LMIYEVSNRP 3933 | SSYTSTSV 3934 |
| 117 | VG9B460 | SNYYWS 3963 | WIGRIYSSGITN 3964 | AGIVGVKGAFA 3965 | VGGYNYVSWY 3966 | LMIYEVSNRP 3967 | SSYTSTSV 3968 |
| 118 | VG9B189 | SNHGMS 3997 | WVASITRGGDTTY 3998 | TRGPLTVGYAMD 3999 | VGGYNYVSWY 4000 | LMIYEVSKRP 4001 | NSYAGSNNFE 4002 |
| 119 | VG9B452 | SNYYWS 4031 | WIGRIYSSGITN 4032 | AGIVGVKGAFA 4033 | VGGYNYVSWY 4034 | LMIYEVSNRP 4035 | SSYTSTSV 4036 |
| 120 | VG9B53 | SSYYWS 4065 | WIGRIHTIGSIN 4066 | AMEGVGATNYYYGMA 4067 | LHSNGYNYLDWY 4068 | LLIYLGSNRA 4069 | MQALQTPY 4070 |
| 121 | VG9B41 | TTYWMH 4099 | WIGLIDPSDSETR 4100 | ASNRWLL 4101 | VHSDGNTYLSWL 4102 | LLIYKISNRF 4103 | VQTREFPL 4104 |
| 122 | VG9B136 | SSNRAAWN 4133 | WLGRTYYRSKWYNE 4134 | ARDLWELREACD 4135 | SSYLAWY 4136 | LLIYVASTLQ 4137 | QQLNSYPF 4138 |
| 123 | VG9B399 | SNYDMN 4167 | WVSSISSSSSYIY 4168 | ARDVGTTDYYYYGMD 4169 | ASSYLAWY 4170 | LLIYGASSRA 4171 | QQYGSSPPY 4172 |
| 124 | VG9B369 | STIGVGVG 4201 | WLSLIYWNDDKR 4202 | AHSHDWVHAFD 4203 | SHYLNWY 4204 | FLIYDASNLD 4205 | QQYDNFPL 4206 |
| 125 | VG9B144 | TGYYMH 4235 | WMGWINPNSGATN 4236 | AREDDAFD 4237 | NYYATWF 4238 | LVFFGKNNRP 4239 | NSRDSSGNHV 4240 |

TABLE 6-continued

Contact CDR Amino Acid Sequences

| # | Protein Name | HC Contact CDR1 | HC Contact CDR2 | HC Contact CDR3 | LC Contact CDR1 | LC Contact CDR2 | LC Contact CDR3 |
|---|---|---|---|---|---|---|---|
| 126 | VG9B410 | SNYGMN 4269 | WVSYISSGSSYKY 4270 | ARDPVVTEYYYYGMD 4271 | NSWLAWY 4272 | LLIYAASSLQ 4273 | QQANSFPW 4274 |
| 127 | VG9B386 | SSYSMI 4303 | WVSSIGSSSTYIY 4304 | ARDGETGGFD 4305 | SRSYLAWY 4306 | LLIYGPSNRA 4307 | QQYGSLPL 4308 |
| 128 | VG9B125 | SSYDMN 4337 | WVSYISSSSTAKY 4338 | AREDIVVVTPILQ 4339 | SKDLAWY 4340 | LLIYDASNRA 4341 | QQRINWPLF 4342 |
| 129 | VG9B112 | SSNSAAWN 4371 | WLGGTYYRSKWFNN 4372 | ARGEWGLRDAFD 4373 | HSYLAWY 4374 | LLIYVASTLQ 4375 | QQLNSYPW 4376 |
| 130 | VG9B371 | SSYDMN 4405 | WVSSISSSSSYIY 4406 | ARDRGVGGTDYYYYGLD 4407 | SSSYLAWY 4408 | LLIYGASSRA 4409 | QQYGSSPPY 4410 |
| 131 | VG9B387 | TGYYLQ 4439 | WMGWINPNSGYTD 4440 | ARLDDAFD 4441 | NYYAIWY 4442 | LVIFGKNNRP 4443 | NSRDSSGNHW 4444 |
| 132 | VG9B47 | SNYAIS 4473 | WMGGIIPFFGTPD 4474 | STGGGYGDYDYYYGIN 4475 | VHSDGNTYLSWL 4476 | LLIYKISNRF 4477 | MQAKEFPL 4478 |
| 133 | VG9B379 | TGDYIH 4507 | WMGWINPNSGGTN 4508 | AREGGVAPAAPDAFD 4509 | SYYARWY 4510 | VVIYGKNNRP 4511 | NSRDSSGNHR 4512 |
| 134 | VG9B447 | SNYYWS 4541 | WIGRIYSSGITN 4542 | AGIVGVKGAFA 4543 | VGGYNYVSWY 4544 | LMIYEVSNRP 4545 | SSYTSTSV 4546 |
| 135 | VG9B392 | TGYYIH 4575 | WMGWINPNSGYTN 4576 | AREDDAFD 4577 | SYYARWY 4578 | LVIYGKNNRP 4579 | NSRDNSGNHV 4580 |
| 136 | VG9B96 | SNYAIS 4609 | WMGGIIPIFSAGT 4610 | SSNSGTYYDYYYGMD 4611 | VHSDGNTYLSWL 4612 | LLIYKIFNRL 4613 | MQAKQFPL 4614 |
| 137 | VG9B77 | SSYAIS 4643 | WMGGIIPFFGTAD 4644 | ATATVTTDYYYGMD 4645 | VHSDGNTYLSWL 4646 | LLIYEISNRF 4647 | MQARQFPL 4648 |

TABLE 7

IMGT CDR Amino Acid Sequences

| # | Protein Name | HC IMGT CDR1 | HC IMGT CDR2 | HC IMGT CDR3 | LC IMGT CDR1 | LC IMGT CDR2 | LC IMGT CDR3 |
|---|---|---|---|---|---|---|---|
| 1 | VG9B54 | GFAFSSYS 25 | ISSSSSYI 26 | ATDGELGPFDY 27 | QSVSSSY 28 | GAS 29 | QQYGRSPLT 30 |
| 2 | VG9B121 | GFTFSDYA 59 | ISSTSNYI 60 | ANSYNWNYGGAFDI 61 | QSVSSSY 62 | GAS 63 | QQYGRSPLT 64 |
| 3 | VG9B429 | GFTFSNYD 93 | ISSSSSYI 94 | ARDVGVTTDYYYYGMDV 95 | QGINSW 96 | AAS 97 | QQANSFPWT 98 |
| 4 | VG9B370 | RFTLSSYD 127 | ISSSSSYI 128 | ARDRGVGGTDYYYYGLDV 129 | QSVSSSY 130 | GAS 131 | QQYGSSPPYT 132 |
| 5 | VG9B80 | GFTFSTYS 161 | ISSSSSYI 162 | AKDGELGVFDY 163 | QSISSSY 164 | GPS 165 | QQFGRSPLT 166 |
| 6 | VG9B414 | GFTFSNYD 195 | ISSSSSYI 196 | ARDVGVTTDYYYYGMDV 197 | QGINSW 198 | AAS 199 | QQANSFPWT 200 |
| 7 | VG9B195 | GFTFSPYT 229 | ISSSSSYM 230 | ARDGDLVGPTYYFDY 231 | KLGDKY 232 | QHN 233 | QAWDSTTVV 234 |
| 8 | VG9B140 | GFTFRSYD 263 | ISTSSGYI 264 | ARDRGIAVAGDYYYGMDV 265 | QSVSSSY 266 | GAS 267 | QQYGSSPPYT 268 |
| 9 | VG9B426 | GFTFSNYD 297 | ISSSSSYI 298 | ARDVGVTTDYYYYGMDV 299 | QSVASSY 300 | GAS 301 | QQYGSSPPYT 302 |
| 10 | VG9B46 | GFTFSINS 331 | ISSTSDYI 332 | VRDDVFGAFDI 333 | QSVSRSY 334 | GSS 335 | QQYSRSPLT 336 |

TABLE 7-continued

IMGT CDR Amino Acid Sequences

| # | Protein Name | HC IMGT CDR1 | HC IMGT CDR2 | HC IMGT CDR3 | LC IMGT CDR1 | LC IMGT CDR2 | LC IMGT CDR3 |
|---|---|---|---|---|---|---|---|
| 11 | VG9B416 | GFTFSNYD 365 | ISSSSSYI 366 | ARDVGVTTDYYYYGMDV 367 | QSVASSY 368 | GAS 369 | QQYGSSPPYT 370 |
| 12 | VG9B69 | GFTFSSYD 399 | ITSSSYYI 400 | ARDLGVRGVDYYYYGLDV 401 | QSVSSSY 402 | GAS 403 | QQYGSSPPYT 404 |
| 13 | VG9B415 | GFTFSNYD 433 | ISSSSSYI 434 | ARDVGVTTDYYYYGMDV 435 | QSVASSY 436 | GAS 437 | QQYGSSPPYT 438 |
| 14 | VG9B104 | GFTFSVYS 467 | IGSSSSYI 468 | GRDHDYGGLDY 469 | QSVSSSY 470 | GPS 471 | QQYGRSPLT 472 |
| 15 | VG9B198 | GDSISSIY 501 | IYTTDIT 502 | AKNGYSYGGFNY 503 | SSNIGAGYD 504 | GDS 505 | QSYDSSLSVVV 506 |
| 16 | VG9B463 | GFTFSNYD 535 | ISSSSSYI 536 | ARDVGVTTDYYYYGMDV 537 | SSNIGSNT 538 | TNT 539 | AAWDDSLNAWV 540 |
| 17 | VG9B469 | GFTFSHYD 569 | ISSSSSYI 570 | ARDRGVGDTSDYYSFGLDV 571 | QNVSSTY 572 | GAC 573 | QQYGSSPPYT 574 |
| 18 | VG9B428 | GFTFSNYG 603 | ISSGSSYK 604 | ARDPVVTEYYYYGMDV 605 | QGINSW 606 | AAS 607 | QQANSFPWT 608 |
| 19 | VG9B430 | GFTFSSYD 637 | ISSSSSYI 638 | ARDVGVTTDYYYYGMDV 639 | QSVASSY 640 | GAS 641 | QQYGSSPPYT 642 |
| 20 | VG9B423 | GFTFSNYD 671 | ISSSSSYI 672 | ARDVGVTTDYYYYGMDV 673 | QSVASSY 674 | GAS 675 | QQYGSSPPYT 676 |
| 21 | VG9B98 | GFTFSSYS 705 | IGSSSTYI 706 | ARDGELGPFEY 707 | QSVSTSY 708 | GTS 709 | LQYGRSPLT 710 |
| 22 | VG9B73 | GFTFSNYD 739 | ISSSSSYI 740 | AREIGVTGTTYYQDYGMDV 741 | QSFSSNY 742 | GAS 743 | QQYGSSPPFT 744 |
| 23 | VG9B133 | GFTFSNYD 773 | ISSSSSYI 774 | ARDLGITGTTMDYYYYGMDV 775 | QSVSSSY 776 | GAS 777 | QQYGSSPPYT 778 |
| 24 | VG9B368 | GFTFNSYD 807 | ISSSSSYI 808 | ARDRGIGGDYYSYAMDV 809 | QSVSSSY 810 | GAS 811 | QQYGSSPPYT 812 |
| 25 | VG9B424 | GFTFSNYD 841 | ISSSSSYI 842 | ARDVGVTTDYYYYGMDV 843 | QSVASSY 844 | GAS 845 | QQYGSSPPYT 846 |
| 26 | VG9B427 | GFTFSNYD 875 | ISSSSSYI 876 | ARDVGVTTDYYYYGMDV 877 | QSVASSY 878 | GAS 879 | QQYGSSPPYT 880 |
| 27 | VG9B417 | GFTFSNYG 909 | ISSGSSYK 910 | ARDPVVTEYYYYGMDV 911 | QGINSW 912 | AAS 913 | QQANSFPWT 914 |
| 28 | VG9B58 | GGSIKSSY 943 | MFYLGST 944 | SRERPVLDAFDI 945 | QDITNY 946 | AAS 947 | LQHDTYPYT 948 |
| 29 | VG9B419 | GFTFSNYD 977 | ISSSSSYI 978 | ARDVGVTTDYYYYGMDV 979 | QSVASSY 980 | GAS 981 | QQYGSSPPYT 982 |
| 30 | VG9B425 | GFTFSNYD 1011 | ISSSSSYI 1012 | ARDVGVTTDYYYYGMDV 1013 | QSVASSY 1014 | GAS 1015 | QQYGSSPPYT 1016 |
| 31 | VG9B143 | GFTFSTYG 1045 | ISTSSYTI 1046 | AREGDWWYFDL 1047 | SSDVGGYNY 1048 | EVS 1049 | SSYTSSSTLV 1050 |
| 32 | VG9B418 | GFTFSNYD 1079 | ISSSSSYI 1080 | ARDVGVTTDYYYYGMDV 1081 | QSVASSY 1082 | GAS 1083 | QQYGSSPPYT 1084 |
| 33 | VG9B472 | GFTFSHYD 1113 | ISSSSSYI 1114 | ARDRGVGDTSDYYSFGLDV 1115 | QGIATY 1116 | AAS 1117 | QKYNSAPPWT 1118 |
| 34 | VG9B421 | GFTFSNYG 1147 | ISSGSSYK 1148 | ARDPVVTEYYYYGMDV 1149 | QGINSW 1150 | AAS 1151 | QQANSFPWT 1152 |
| 35 | VG9B88 | GFTFSSYT 1181 | ISTSSSYI 1182 | ARDGDMVAPIKGSFDY 1183 | QSLLNSDDGNTY 1184 | TLS 1185 | MQRIEFPIT 1186 |

TABLE 7-continued

IMGT CDR Amino Acid Sequences

| # | Protein Name | HC IMGT CDR1 | HC IMGT CDR2 | HC IMGT CDR3 | LC IMGT CDR1 | LC IMGT CDR2 | LC IMGT CDR3 |
|---|---|---|---|---|---|---|---|
| 36 | VG9B384 | GFSLSSSGMC 1215 | IDWFDDK 1216 | ARIRGTGAYYYGLDV 1217 | ELGDKY 1218 | QDN 1219 | QAWDSSKVV 1220 |
| 37 | VG9B413 | GFTFSNYD 1249 | ISSSSSYI 1250 | ARDVGVTTDYYYYGMDV 1251 | QSVASSY 1252 | GAS 1253 | QQYGSSPPYT 1254 |
| 38 | VG9B36 | GFTFSSYG 1283 | ISTGSSYI 1284 | ARDKGLAVTGYIMDV 1285 | QDISNY 1286 | DAS 1287 | QQYDNLPMYT 1288 |
| 39 | VG9B403 | GFTFSNYD 1317 | ISSSSSYI 1318 | ARDVGVTTDYYYYGMDV 1319 | QSVASSY 1320 | GAS 1321 | QQYGSSPPYT 1322 |
| 40 | VG9B191 | GFTFSRYS 1351 | ISSSSSYI 1352 | ARDGPTVNWDYYFDL 1353 | SSNIGNNY 1354 | DNN 1355 | GTWDSSLSTSVV 1356 |
| 41 | VG9B44 | GDSVSSNSAA 1385 | TYYRSKWYN 1386 | ARESGSYYTDGFDI 1387 | QGISSY 1388 | AAS 1389 | QEFNSYPYT 1390 |
| 42 | VG9B67 | GFTFSSYT 1419 | ISSSSSYI 1420 | ARDGDILATIRGSFDY 1421 | QSLLDSDAGNTY 1422 | TLS 1423 | MQRIEFPIT 1424 |
| 43 | VG9B402 | GFTFSNYG 1453 | ISSGSSYK 1454 | ARDPVVTEYYYYGMDV 1455 | QGINSW 1456 | AAS 1457 | QQANSFPWT 1458 |
| 44 | VG9B127 | GFTFGAYT 1487 | ISSSSSYI 1488 | ARDGDIVSTIRGSFDY 1489 | QSLLDSDDGNTY 1490 | TLS 1491 | MQRIEFPIT 1492 |
| 45 | VG9B137 | GITFSSYS 1521 | IGSSSSYI 1522 | ATSYSWNYGGAFDI 1523 | QSVSSSY 1524 | GAS 1525 | QQYGSSPPYT 1526 |
| 46 | VG9B33 | GFTFSSYN 1555 | ISTSSSYI 1556 | ARDTSVTKYPDTFDI 1557 | QDINNY 1558 | GAS 1559 | QKYNSAPFT 1560 |
| 47 | VG9B162 | GYTFTGDY 1589 | INPNSGYT 1590 | AREGDAFDV 1591 | SSDVGGYNY 1592 | EVS 1593 | NSYAGSNNFEV 1594 |
| 48 | VG9B152 | GFTFSSYS 1623 | ISSSSDYI 1624 | ARDWELLGFDC 1625 | KLGDKY 1626 | QHN 1627 | QAWDSTTVV 1628 |
| 49 | VG9B64 | GFSLSISGVS 1657 | IYWNDDK 1658 | VHSGQWLEGDAFDI 1659 | ESLVHSDGNTY 1660 | KIS 1661 | MQATQFPLT 1662 |
| 50 | VG9B21 | GFSFSNYD 1691 | ISSSHYI 1692 | ARDRGVTTDYYYYALDV 1693 | QGIYNY 1694 | AAS 1695 | QKYNRAPFT 1696 |
| 51 | VG9B128 | GFTFGTYG 1725 | IWYNGSNK 1726 | ARGGFGESFDS 1727 | QSVIDY 1728 | DAS 1729 | QQRSNWPLT 1730 |
| 52 | VG9B66 | GFTFSTYT 1759 | ISSSSFYM 1760 | ARDGDIVATIRGSFDY 1761 | QDITNF 1762 | TAS 1763 | QKYNSAPFT 1764 |
| 53 | VG9B32 | GFTFSRYA 1793 | ISGTGYTV 1794 | ARDQEPGFDY 1795 | QSLVHSDGNTY 1796 | KIS 1797 | MQATHFPFT 1798 |
| 54 | VG9B57 | GFTFSSHD 1827 | ISSSSSYI 1828 | ARDLGVGVRDYYYYGMDV 1829 | QDITNY 1830 | AAS 1831 | LQHDTYPYT 1832 |
| 55 | VG9B135 | GFSLTTYGVG 1861 | IYWNDDK 1862 | AHDYDFWSGYFDY 1863 | QSVSSSY 1864 | GAS 1865 | QQYGSSPLT 1866 |
| 56 | VG9B60 | GYTFTGYY 1895 | INPNSGVT 1896 | ARGGSLVRGVISGLDY 1897 | QSFSGSY 1898 | GAS 1899 | QQYGSSPPYT 1900 |
| 57 | VG9B409 | GYTLTSYY 1929 | INPSGGST 1930 | ARGSYGWYFDL 1931 | QSVTSSY 1932 | GAS 1933 | QQYGSSPPYT 1934 |
| 58 | VG9B411 | GFTFSNYD 1963 | ISSSSSYI 1964 | ARDVGVTTDYYYYGMDV 1965 | QGINSW 1966 | AAS 1967 | QQYNNWPRT 1968 |
| 59 | VG9B129 | GGTFSSYV 1997 | ILPILSTA 1998 | ARAHDYYYGMDV 1999 | QSVSNNY 2000 | GAS 2001 | QQYGSSPPYT 2002 |
| 60 | VG9B396 | GDSIRGYY 2031 | IFTTGNT 2032 | AREKWDSSSSALYFDF 2033 | SSNIGADYD 2034 | GNT 2035 | QSYDSRLTGYVV 2036 |

TABLE 7-continued

IMGT CDR Amino Acid Sequences

| Protein # | Name | HC IMGT CDR1 | HC IMGT CDR2 | HC IMGT CDR3 | LC IMGT CDR1 | LC IMGT CDR2 | LC IMGT CDR3 |
|---|---|---|---|---|---|---|---|
| 61 | VG9B470 | GFSLTTSGVG 2065 | ILWNDHT 2066 | ARDKWELRDAFDI 2067 | QGISRY 2068 | VAS 2069 | QQLISYPYT 2070 |
| 62 | VG9B111 | GFTFSTYS 2099 | ISSDSSYI 2100 | ARDSVTGPFDY 2101 | QDISHY 2102 | DSY 2103 | QQYDNLPYT 2104 |
| 63 | VG9B169 | GGSITNYF 2133 | IFYSGST 2134 | ARVGRWELRTAFDI 2135 | SSNIGSNT 2136 | SNN 2137 | AAWDDSLNGPGV 2138 |
| 64 | VG9B639 | GFTFTTYR 2167 | ISSSSIYI 2168 | ARERVYTVSFDY 2169 | QDISHY 2170 | DSY 2171 | QQYDNLPYT 2172 |
| 65 | VG9B201 | GFSLTTHGVG 2201 | IYWNADK 2202 | AHEGDWGHYFDF 2203 | SSNIGNND 2204 | DNN 2205 | ETWDSSLSAIWV 2206 |
| 66 | VG9B161 | GGSISSYF 2235 | IFYSGST 2236 | ARVGRWELRGAFDI 2237 | SSNIGSNT 2238 | SNN 2239 | AAWDDSLNSPGV 2240 |
| 67 | VG9B383 | SGSISSYY 2269 | IYTIGNT 2270 | AREGYYDSSGSFFPGAFGI 2271 | SNDVGSYNL 2272 | AGS 2273 | CSFAGATNVV 2274 |
| 68 | VG9B382 | GDSISGYY 2303 | IFTTGNT 2304 | ARERWDSSSSALYFDY 2305 | SSNIGADYD 2306 | GNS 2307 | QSYDSSMSGYVV 2308 |
| 69 | VG9B156 | NGSISGYF 2337 | IFYSGST 2338 | AKLGKWELRTAFDI 2339 | TSNIGSDT 2340 | SNN 2341 | AAWDDSLNGPV 2342 |
| 70 | VG9B205 | NGSISGYF 2371 | IFYSGST 2372 | AKLGKWELRTAFDI 2373 | KLGDKY 2374 | QDS 2375 | QAWDSSTVV 2376 |
| 71 | VG9B86 | GDSISSSY 2405 | FYSSGST 2406 | ARYSGSYWYFDL 2407 | QSVSSY 2408 | DTS 2409 | QQRSDWLLT 2410 |
| 72 | VG9B154 | GGSISYYF 2439 | IYYSGST 2440 | AREGKWELRTTFDI 2441 | SSNIGSNT 2442 | SNN 2443 | AAWDDSLNGPV 2444 |
| 73 | VG9B159 | GGSISSYY 2473 | FYTGGRN 2474 | ARDMEYYYDRSGYSYWYFDL 2475 | NIGSKS 2476 | DDS 2477 | QVWDSSSDHVV 2478 |
| 74 | VG9B465 | GGSITSYY 2507 | IYTIGNT 2508 | AREGYYESDGSFFPGAFNI 2509 | SNDVGSYNL 2510 | AGS 2511 | CSYAGTTNVV 2512 |
| 75 | VG9B194 | GYTFTGDY 2541 | INPNSGYT 2542 | TRELDALDV 2543 | SSDVGGYNY 2544 | EVS 2545 | NSYAGSNNFEV 2546 |
| 76 | VG9B182 | GDSINNHF 2575 | VFYNGNT 2576 | ARVGRWVLRTAFDI 2577 | SSNIGSNT 2578 | SNN 2579 | AAWDDSLNGPGV 2580 |
| 77 | VG9B173 | GGSINNYF 2609 | IYYSGST 2610 | AREGKWELRSAFDI 2611 | SSNIESNT 2612 | SNN 2613 | TAWDDSLNGPV 2614 |
| 78 | VG9B87 | GYTFTSEY 2643 | INPSGGST 2644 | ARERGYSYGSFDY 2645 | QGISSY 2646 | AAS 2647 | QQFNSYSLT 2648 |
| 79 | VG9B208 | GGSISGYY 2677 | IFYSGSI 2678 | ARVGKWELRSSFDI 2679 | TSNIGNND 2680 | DNN 2681 | GTWDSSLSVWV 2682 |
| 80 | VG9B372 | GGSISNGGFY 2711 | INYSGST 2712 | ARDRNYEWNFDL 2713 | QSVSSY 2714 | DAS 2715 | QQRSNWPLT 2716 |
| 81 | VG9B186 | GFSLTNIRMS 2745 | IFSNDEK 2746 | ARMRLPYGMDV 2747 | TSNIGSNT 2748 | SNN 2749 | AAWDDSLNGPV 2750 |
| 82 | VG9B177 | GGSINNYF 2779 | IFYSGST 2780 | ARVGKWELRTAFDI 2781 | SSDVADYNY 2782 | EVS 2783 | CSYTSSFTVV 2784 |
| 83 | VG9B114 | GFTFSRYD 2813 | IGSAGDT 2814 | ARGKWELRDAFDI 2815 | QGIHSY 2816 | VAS 2817 | QQLNSYPYT 2818 |
| 84 | VG9B147 | GGSISGYF 2847 | IFYSGST 2848 | AREGKWELRSTFDI 2849 | SLRSYY 2850 | GEN 2851 | NSRDTGDHHLV 2852 |
| 85 | VG9B65 | GGTFNIYA 2881 | IIPFFGTA 2882 | ARGGDSGYDWGFDY 2883 | QSLVHSDGNTY 2884 | QIS 2885 | MQATQFPLT 2886 |

TABLE 7-continued

IMGT CDR Amino Acid Sequences

| # | Protein Name | HC IMGT CDR1 | HC IMGT CDR2 | HC IMGT CDR3 | LC IMGT CDR1 | LC IMGT CDR2 | LC IMGT CDR3 |
|---|---|---|---|---|---|---|---|
| 86 | VG9B81 | GGSINTYY 2915 | IYTSDNT 2916 | ARYNWNYWYFDL 2917 | QGISSY 2918 | TAS 2919 | QHLNSYPYT 2920 |
| 87 | VG9B203 | GDSIGHYY 2949 | IYTSGST 2950 | ARSGGNFYWYFDL 2951 | SSNIGNNY 2952 | DNN 2953 | GTWDSSLSAGV 2954 |
| 88 | VG9B380 | GGSISNYY 2983 | IYPSGIT 2984 | AGIMGTKGAFDI 2985 | SSDVGGYNY 2986 | EVS 2987 | SSYTSTSVV 2988 |
| 89 | VG9B103 | GGTFSSYA 3017 | IIPIFGTA 3018 | ARGVGWGTDYYYGLDV 3019 | QGLVHSDGNTY 3020 | KIS 3021 | MQATHHPLT 3022 |
| 90 | VG9B462 | GGSISNYY 3051 | IYSSGIT 3052 | AGIVGVKGAFAI 3053 | SSDVGGYNY 3054 | EVS 3055 | SSYTSTSVV 3056 |
| 91 | VG9B461 | GGSISNYY 3085 | IYSSGIT 3086 | AGIVGVKGAFAI 3087 | SSDVGGYNY 3088 | EVS 3089 | SSYTSTSVV 3090 |
| 92 | VG9B106 | GYTFTGYY 3119 | INPSSGDT 3120 | ANELGIGVFDY 3121 | QSVLYSSNNKNY 3122 | WAS 3123 | QQYYSIPYT 3124 |
| 93 | VG9B115 | GFSLSTYGVG 3153 | IYWNDDK 3154 | SHESDWSYYFDY 3155 | QSVSSY 3156 | DAS 3157 | QQRSSWPWT 3158 |
| 94 | VG9B27 | GGTFSSYV 3187 | ILPILSTA 3188 | ARAHDYYYGMDV 3189 | QSLVHSDGNTY 3190 | KIS 3191 | MQATHHPLT 3192 |
| 95 | VG9B458 | GGSISNYY 3221 | IYSSGIT 3222 | AGIVGVKGAFAI 3223 | SSDVGGYNY 3224 | EVS 3225 | SSYTSTSVV 3226 |
| 96 | VG9B131 | GFTFSSYD 3255 | ISSSSTAK 3256 | AREDIVVVTPILQH 3257 | QSVSNY 3258 | DAS 3259 | QQRSNWT 3260 |
| 97 | VG9B163 | GFTFSNHG 3289 | ITRGGDTT 3290 | TRGPLTVGYAMDY 3291 | SSNIGHNY 3292 | DNN 3293 | GIWDSSLSIVV 3294 |
| 98 | VG9B454 | GGSISNYY 3323 | IYSSGIT 3324 | AGIVGVKGAFAI 3325 | SSDVGGYNY 3326 | EVS 3327 | SSYTSTSVV 3328 |
| 99 | VG9B439 | GGSISNYY 3357 | IYSSGIT 3358 | AGIVGVKGAFAI 3359 | SSDVGGYNY 3360 | EVS 3361 | SSYTSTSVV 3362 |
| 100 | VG9B68 | GGTFSTYA 3391 | IIPIFGTA 3392 | ARGVGWGSDYYYGLDV 3393 | QSLVHSDGNTY 3394 | KIS 3395 | IQATHHPLT 3396 |
| 101 | VG9B449 | GGSISNYY 3425 | IYSSGIT 3426 | AGIVGVKGAFAI 3427 | SSDVGGYNY 3428 | EVS 3429 | SSYTSTSVV 3430 |
| 102 | VG9B204 | YGSFSSFY 3459 | IYTSGGT 3460 | ARWLRAFDY 3461 | KLGDKY 3462 | QDS 3463 | QAWDSSTVV 3464 |
| 103 | VG9B459 | GGSISNYY 3493 | IYSSGIT 3494 | AGIVGVKGAFAI 3495 | SSDVGGYNY 3496 | EVS 3497 | SSYTSTSVV 3498 |
| 104 | VG9B157 | GFTFSNHG 3527 | ITRGGDTT 3528 | TRGPLTVGYAMDY 3529 | SLRSYY 3530 | GEN 3531 | NSRDTGDHHLV 3532 |
| 105 | VG9B453 | GGSISNYY 3561 | IYSSGIT 3562 | AGIVGVKGAFAI 3563 | SSDVGGYNY 3564 | EVS 3565 | SSYTSTSVV 3566 |
| 106 | VG9B443 | GGSISNYY 3595 | IYSSGIT 3596 | AGIVGVKGAFAI 3597 | SSDVGGYNY 3598 | EVS 3599 | SSYTSTSVV 3600 |
| 107 | VG9B455 | GGSISNYY 3629 | IYSSGIT 3630 | AGIVGVKGAFAI 3631 | SSDVGGYNY 3632 | EVS 3633 | SSYTSTSVV 3634 |
| 108 | VG9B466 | GGSISNYY 3663 | IYSSGIT 3664 | AGIVGVKGAFAI 3665 | SSDVGGYNY 3666 | EVS 3667 | SSYTSTSVV 3668 |
| 109 | VG9B450 | GGSISNYY 3697 | IYSSGIT 3698 | AGIVGVKGAFAI 3699 | SSDVGGYNY 3700 | EVS 3701 | SSYTSTSVV 3702 |
| 110 | VG9B438 | GGSISNYY 3731 | IYSSGIT 3732 | AGIVGVKGAFAI 3733 | SSDVGGYNY 3734 | EVS 3735 | SSYTSTSVV 3736 |

TABLE 7-continued

IMGT CDR Amino Acid Sequences

| # | Protein Name | HC IMGT CDR1 | HC IMGT CDR2 | HC IMGT CDR3 | LC IMGT CDR1 | LC IMGT CDR2 | LC IMGT CDR3 |
|---|---|---|---|---|---|---|---|
| 111 | VG9B464 | GGSISNYY 3765 | IYSSGIT 3766 | AGIVGVKGAFAI 3767 | SSDVGGYNY 3768 | EVS 3769 | SSYTSTSVV 3770 |
| 112 | VG9B437 | GGSISNYY 3799 | IYSSGIT 3800 | AGIVGVKGAFAI 3801 | SSDVGGYNY 3802 | EVS 3803 | SSYTSTSVV 3804 |
| 113 | VG9B457 | GGSISNYY 3833 | IYSSGIT 3834 | AGIVGVKGAFAI 3835 | SSDVGGYNY 3836 | EVS 3837 | SSYTSTSVV 3838 |
| 114 | VG9B442 | GGSISNYY 3867 | IYSSGIT 3868 | AGIVGVKGAFAI 3869 | SSDVGGYNY 3870 | EVS 3871 | SSYTSTSVV 3872 |
| 115 | VG9B436 | GGSISNYY 3901 | IYSSGIT 3902 | AGIVGVKGAFAI 3903 | SSDVGGYNY 3904 | EVS 3905 | SSYTSTSVV 3906 |
| 116 | VG9B434 | GGSISNYY 3935 | IYSSGIT 3936 | AGIVGVKGAFAI 3937 | SSDVGGYNY 3938 | EVS 3939 | SSYTSTSVV 3940 |
| 117 | VG9B460 | GGSISNYY 3969 | IYSSGIT 3970 | AGIVGVKGAFAI 3971 | SSDVGGYNY 3972 | EVS 3973 | SSYTSTSVV 3974 |
| 118 | VG9B189 | GFTFSNHG 4003 | ITRGGDTT 4004 | TRGPLTVGYAMDY 4005 | SSDVGGYNY 4006 | EVS 4007 | NSYAGSNNFEV 4008 |
| 119 | VG9B452 | GGSISNYY 4037 | IYSSGIT 4038 | AGIVGVKGAFAI 4039 | SSDVGGYNY 4040 | EVS 4041 | SSYTSTSVV 4042 |
| 120 | VG9B53 | GGSISSYY 4071 | IHTIGSI 4072 | AMEGVGATNYYYGMAV 4073 | QSLLHSNGYNY 4074 | LGS 4075 | MQALQTPYT 4076 |
| 121 | VG9B41 | GYSFTTYW 4105 | IDPSDSET 4106 | ASNRWLLG 4107 | QSLVHSDGNTY 4108 | KIS 4109 | VQTREFPLT 4110 |
| 122 | VG9B136 | GDSVSSNRAA 4139 | TYYRSKWYN 4140 | ARDLWELREACDI 4141 | QGISSY 4142 | VAS 4143 | QQLNSYPFT 4144 |
| 123 | VG9B399 | GFTFSNYD 4173 | ISSSSSYI 4174 | ARDVGVTTDYYYYGMDV 4175 | QSVASSY 4176 | GAS 4177 | QQYGSSPPYT 4178 |
| 124 | VG9B369 | GFSLSTIGVG 4207 | IYWNDDK 4208 | AHSHDWVHAFDI 4209 | QDISHY 4210 | DAS 4211 | QQYDNFPLT 4212 |
| 125 | VG9B144 | GYTFTGYY 4241 | INPNSGAT 4242 | AREDDAFDV 4243 | NLRNYY 4244 | GKN 4245 | NSRDSSGNHVV 4246 |
| 126 | VG9B410 | GFTFSNYG 4275 | ISSGSSYK 4276 | ARDPVVTEYYYYGMDV 4277 | QGINSW 4278 | AAS 4279 | QQANSFPWT 4280 |
| 127 | VG9B386 | GFTFSSYS 4309 | IGSSSTYI 4310 | ARDGETGGFDY 4311 | QSISRSY 4312 | GPS 4313 | QQYGSLPLT 4314 |
| 128 | VG9B125 | GFTFSSYD 4343 | ISSSSTAK 4344 | AREDIVVVTPILQH 4345 | QSVSKD 4346 | DAS 4347 | QQRINWPLFT 4348 |
| 129 | VG9B112 | GDSVSSNSAA 4377 | TYYRSKWFN 4378 | ARGEWGLRDAFDI 4379 | QGIHSY 4380 | VAS 4381 | QQLNSYPWT 4382 |
| 130 | VG9B371 | RFTLSSYD 4411 | ISSSSSYI 4412 | ARDRGVGGTDYYYYGLDV 4413 | QSVSSSY 4414 | GAS 4415 | QQYGSSPPYT 4416 |
| 131 | VG9B387 | GFTFTGYY 4445 | INPNSGYT 4446 | ARLDDAFDV 4447 | SLRNYY 4448 | GKN 4449 | NSRDSSGNHWV 4450 |
| 132 | VG9B47 | GGSFSNYA 4479 | IIPFFGTP 4480 | STGGGYGDYYYYGINV 4481 | QSLVHSDGNTY 4482 | KIS 4483 | MQAKEFPLT 4484 |
| 133 | VG9B379 | GYTFTGDY 4513 | INPNSGGT 4514 | AREGGVAPAAPDAFDI 4515 | SLRSYY 4516 | GKN 4517 | NSRDSSGNHRV 4518 |
| 134 | VG9B447 | GGSISNYY 4547 | IYSSGIT 4548 | AGIVGVKGAFAI 4549 | SSDVGGYNY 4550 | EVS 4551 | SSYTSTSVV 4552 |
| 135 | VG9B392 | GYTFTGYY 4581 | INPNSGYT 4582 | AREDDAFDI 4583 | SLRSYY 4584 | GKN 4585 | NSRDNSGNHVV 4586 |

TABLE 7-continued

IMGT CDR Amino Acid Sequences

| # | Protein Name | HC IMGT CDR1 | HC IMGT CDR2 | HC IMGT CDR3 | LC IMGT CDR1 | LC IMGT CDR2 | LC IMGT CDR3 |
|---|---|---|---|---|---|---|---|
| 136 | VG9B96 | GGTFSNYA 4615 | IIPIFSAG 4616 | SSNSGTYYDYYYGMDV 4617 | QSLVHSDGNTY 4618 | KIF 4619 | MQAKQFPLT 4620 |
| 137 | VG9B77 | GGTFSSYA 4649 | IIPFFGTA 4650 | ATATVTTDYYYGMDV 4651 | QSLVHSDGNTY 4652 | EIS 4653 | MQARQFPLT 4654 |

Variable Region Cloning. Both RNA purified by QIAGEN kit (RNEASY Plus Mini Kit) and B cells lysate were used for cDNA synthesis using the Smarter cDNA synthesis kit (Clontech, Mount View, CA). To facilitate cDNA synthesis, oligodT was used to prime reverse transcription of all messenger RNAs followed by "5' capping" with a Smarter IIA oligonucleotide. Subsequent amplification of the VH and VL fragments was performed using a two-step PCR amplification using 5' primers targeting the SMARTER IIA cap and 3' primers targeting consensus regions in CH1. Briefly, each 50 µl PCR reaction consists of 20 µM of forward and reverse primer mixes, 25 µl of PRIMESTAR MAX DNA polymerase premix (Clontech), 2 µl of unpurified cDNA, and 21 µl of double-distilled H2O. The cycling program started at 94° C. for 3 min., followed by 35 cycles (94° C. for 30 sec., 55° C. for 1 min., 68° C. for 1 min.), and ended at 72° C. for 7 min. The second round PCR was performed with VL and VH second round primers containing 15 bp complementary extensions that "overlap" respective regions in their respective Lonza mother vector (VH and VL). Second round PCR was performed with the following program: 94° C. for 3 min.; 35 cycles (94° C. for 30 sec., 55° C. for 1 min., 68° C. for 1 min.), and ended at 72° C. for 7 min. IN-FUSION® HD Cloning Kit (Clonetech, U.S.A.) was used for directional cloning of VL gene into Lonza huIgK or Lambda vector and VH gene into Lonza huIgG1 vector. To facilitate IN-FUSION® HD Cloning, PCR products were treated with Cloning Enhancer before IN-FUSION HD Cloning. Cloning and transformation were performed according to manufacturer's protocol (Clonetech, U.S.A.). Mini-prep DNAs were subjected to Sanger sequencing to confirm that complete V-gene fragments were obtained.

1.3 Binding Activity of TRGV9, TRDV2 and TRGDC Antibodies on Target Cell Lines.

Binding of antibodies to human γδ T cells or SKW cell lines expressing Vγ9/Vδ2, Vγ9/Vδ2 or Vγ5/Vδ2 was carried out by flow cytometry. Briefly, the cells were centrifuged at 300×g for 5 minutes and the pellet was resuspended in 34 ml fresh media (in RPMI+10% FBS). 50 µL of the cells were then plated (44K cells/well) into assay plates. Samples were incubated for one hour at 37° C. in tissue culture (TC) incubator followed by wash steps by adding 100 µl FACS staining buffer. Secondary detention antibodies (A647 conjugated anti-human IgG Fc specific antibody (2 µg/mL) along with AF488 anti mouse CD3, clone OKT3 at 1 ug/mL) were added at 50 µL/well to appropriate wells according to the plate map. After incubating for 60 minutes at 37° C. in the TC incubator, cells were again washed as described above. This is followed by resuspension in 20 µL/well running buffer containing 1:1000 dilution of Sytox blue dead cell stain and the plates were run on iQue Screener.

Gating and data analysis: Human anti-human Vγ9 antibody (VG9B2 mAb at 10 nM) was used to mark the gating of positive population. All cells were first gated for singlets on SCS-A vs. SCS-H dot plot, live/dead followed by CD3 positive population, and this subset of CD3 positive population was gated for Vγ9 positive binding using positive control mAb. Cells were also assessed for cell binding of control mAbs by RL1 (A647) Geomeans from the live cell population. Advanced metrics were used and normalization metrics were chosen to calculate fold over background wells containing secondary antibody alone (designated as 'background' within ForeCyt settings). The results were exported to GeneData screener to graph and summarize results, which are shown in Table 8.

TABLE 8

Antibody Binding

| | | | | SKW-Cell Lines | | |
|---|---|---|---|---|---|---|
| # | Protein Name | Specificity | Human γδ T cells DRC Binding Flow 37° C.: AG000003021 (γδ T cells) Max. Activity | DRC Binding Flow 37° C.: AG000003284 (SKW3_4 expressing Vg9/Vd2) [CLI000001324 (C3819A)] Max. Activity | DRC Binding Flow 37° C.: AG000003287 (SKW3 expressing Vg9/Vd1) [CLI000001326 (C3821A)] Max. Activity | DRC Binding Flow 37° C.: AG000003285 (SKW3 expressing Vg5/Vd2) [CLI000001325 (C3820A)] Max. Activity |
| 1 | VG9B54 | Vg9 | 4287.92 | 165.54 | 348.47 | 2.49 |
| 2 | VG9B121 | Vg9 | 3666.93 | 160.56 | 360.43 | 18.44 |
| 3 | VG9B429 | Vg9 | 3637.59 | 177.29 | 420.69 | 1.76 |
| 4 | VG9B370 | Vg9 | 3529.08 | 183.63 | 424.06 | 2.63 |
| 5 | VG9B80 | Vg9 | 3480.37 | 133.20 | 313.72 | 2.24 |
| 6 | VG9B414 | Vg9 | 3295.02 | 195.62 | 498.04 | 10.02 |
| 7 | VG9B195 | Vg9 | 3257.31 | 119.35 | 299.67 | 10.31 |
| 8 | VG9B140 | Vg9 | 3226.11 | 133.46 | 325.32 | 2.78 |

TABLE 8-continued

Antibody Binding

| | | | | SKW-Cell Lines | | |
| | | | | DRC Binding Flow 37° C.: AG000003284 (SKW3_4 expressing Vg9/Vd2) [CLI000001324 (C3819A)] | DRC Binding Flow 37° C.: AG000003287 (SKW3 expressing Vg9/Vd1) [CLI000001326 (C3821A)] | DRC Binding Flow 37° C.: AG000003285 (SKW3 expressing Vg5/Vd2) [CLI000001325 (C3820A)] |
| # | Protein Name | Specificity | Human γδ T cells DRC Binding Flow 37° C.: AG000003021 (γδ T cells) Max. Activity | Max. Activity | Max. Activity | Max. Activity |
|---|---|---|---|---|---|---|
| 9 | VG9B426 | Vg9 | 3212.79 | 154.44 | 339.73 | 2.40 |
| 10 | VG9B46 | Vg9 | 3207.94 | 164.92 | 349.12 | 1.95 |
| 11 | VG9B416 | Vg9 | 3122.34 | 180.59 | 420.36 | 1.91 |
| 12 | VG9B69 | Vg9 | 3109.88 | 147.17 | 341.06 | 3.35 |
| 13 | VG9B415 | Vg9 | 3077.36 | 173.88 | 411.15 | 2.66 |
| 14 | VG9B104 | Vg9 | 3052.98 | 147.85 | 358.46 | 1.90 |
| 15 | VG9B198 | Vg9 | 3042.49 | 160.00 | 372.45 | 1.89 |
| 16 | VG9B463 | Vg9 | 3032.24 | 144.29 | 321.13 | 4.19 |
| 17 | VG9B469 | Vg9 | 3003.65 | 168.31 | 399.44 | 1.44 |
| 18 | VG9B428 | Vg9 | 2984.79 | 162.05 | 346.00 | 2.86 |
| 19 | VG9B430 | Vg9 | 2965.48 | 142.74 | 324.73 | 1.49 |
| 20 | VG9B423 | Vg9 | 2963.87 | 155.60 | 344.61 | 2.87 |
| 21 | VG9B98 | Vg9 | 2879.14 | 153.54 | 343.86 | 2.47 |
| 22 | VG9B73 | Vg9 | 2844.52 | 117.98 | 317.45 | 1.79 |
| 23 | VG9B133 | Vg9 | 2835.38 | 143.97 | 307.41 | 5.97 |
| 24 | VG9B368 | Vg9 | 2784.27 | 185.70 | 398.79 | 3.23 |
| 25 | VG9B424 | Vg9 | 2782.65 | 154.63 | 341.58 | 19.79 |
| 26 | VG9B427 | Vg9 | 2728.10 | 151.51 | 344.45 | 1.82 |
| 27 | VG9B417 | Vg9 | 2698.70 | 169.62 | 424.38 | 2.15 |
| 28 | VG9B58 | Vg9 | 2694.07 | 159.70 | 350.03 | 1.49 |
| 29 | VG9B419 | Vg9 | 2689.29 | 171.96 | 400.28 | 1.87 |
| 30 | VG9B425 | Vg9 | 2664.04 | 155.86 | 368.27 | 1.87 |
| 31 | VG9B143 | Vg9 | 2629.19 | 97.35 | 241.41 | 1.07 |
| 32 | VG9B418 | Vg9 | 2625.01 | 190.37 | 397.53 | 3.80 |
| 33 | VG9B472 | Vg9 | 2618.27 | 171.46 | 327.75 | 2.22 |
| 34 | VG9B421 | Vg9 | 2613.21 | 164.91 | 357.78 | 2.16 |
| 35 | VG9B88 | Vg9 | 2559.14 | 153.54 | 345.70 | 18.78 |
| 36 | VG9B384 | Vg9 | 2546.76 | 120.75 | 289.57 | 18.67 |
| 37 | VG9B413 | Vg9 | 2472.53 | 184.38 | 405.73 | 4.47 |
| 38 | VG9B36 | Vg9 | 2411.74 | 156.79 | 354.36 | 2.45 |
| 39 | VG9B403 | Vg9 | 2388.25 | 192.50 | 426.04 | 2.43 |
| 40 | VG9B191 | Vg9 | 2366.62 | 155.61 | 381.04 | 17.18 |
| 41 | VG9B44 | Vg9 | 2317.34 | 169.68 | 375.29 | 2.13 |
| 42 | VG9B67 | Vg9 | 2267.90 | 128.38 | 317.80 | 1.14 |
| 43 | VG9B402 | Vg9 | 2245.94 | 175.93 | 390.71 | 2.50 |
| 44 | VG9B127 | Vg9 | 2225.81 | 91.86 | 317.54 | 1.78 |
| 45 | VG9B137 | Vg9 | 2199.84 | 133.26 | 316.80 | 1.84 |
| 46 | VG9B33 | Vg9 | 2093.60 | 173.44 | 377.35 | 2.85 |
| 47 | VG9B162 | Vg9 | 1855.16 | 96.27 | 249.35 | 2.44 |
| 48 | VG9B152 | Vg9 | 1851.56 | 140.95 | 351.66 | 1.64 |
| 49 | VG9B64 | Vg9 | 1688.57 | 100.31 | 259.64 | 2.22 |
| 50 | VG9B21 | Vg9 | 1672.33 | 39.71 | 121.09 | 1.86 |
| 51 | VG9B128 | Vg9 | 1483.38 | 120.69 | 215.26 | 11.39 |
| 52 | VG9B66 | Vg9 | 1223.28 | 33.87 | 179.02 | 1.04 |
| 53 | VG9B32 | Vg9 | 1211.08 | 40.02 | 108.12 | 2.52 |
| 54 | VG9B57 | Vg9 | 1206.73 | 30.76 | 75.94 | 1.04 |
| 55 | VG9B135 | Vg9 | 577.24 | 15.10 | 59.87 | 2.65 |
| 56 | VG9B60 | Vg9 | 567.17 | 16.70 | 40.58 | 1.42 |
| 57 | VG9B409 | Vg9 | 410.62 | 176.35 | 408.24 | 8.45 |
| 58 | VG9B411 | Vg9 | 396.41 | 19.12 | 24.89 | 2.76 |
| 59 | VG9B129 | Vg9 | 271.32 | 10.36 | 23.35 | 1.13 |
| 60 | VG9B396 | Vd2 | 4543.78 | 154.68 | 2.19 | 222.19 |
| 61 | VG9B470 | Vd2 | 4273.42 | 166.74 | 1.59 | 231.07 |
| 62 | VG9B111 | Vd2 | 3433.67 | 116.94 | 1.92 | 154.43 |
| 63 | VG9B169 | Vd2 | 3246.37 | 165.28 | 2.21 | 175.26 |
| 64 | VG9B639 | Vd2 | 3236.63 | 155.28 | 1.29 | 185.68 |
| 65 | VG9B201 | Vd2 | 3170.12 | 152.35 | 2.74 | 204.61 |
| 66 | VG9B161 | Vd2 | 2819.85 | 180.14 | 1.43 | 210.72 |
| 67 | VG9B383 | Vd2 | 2778.28 | 183.98 | 1.36 | 283.96 |
| 68 | VG9B382 | Vd2 | 2775.57 | 176.98 | 1.04 | 275.40 |
| 69 | VG9B156 | Vd2 | 2698.68 | 152.58 | 1.60 | 169.64 |
| 70 | VG9B205 | Vd2 | 2689.76 | 153.49 | 2.04 | 161.98 |
| 71 | VG9B86 | Vd2 | 2670.16 | 137.94 | 1.16 | 206.91 |
| 72 | VG9B154 | Vd2 | 2592.95 | 152.88 | 1.09 | 92.70 |
| 73 | VG9B159 | Vd2 | 2505.10 | 123.26 | 1.58 | 11.37 |
| 74 | VG9B465 | Vd2 | 2500.83 | 148.03 | 7.28 | 214.03 |

TABLE 8-continued

Antibody Binding

| | | | | SKW-Cell Lines | | |
|---|---|---|---|---|---|---|
| # | Protein Name | Specificity | Human γδ T cells DRC Binding Flow 37° C.: AG000003021 (γδ T cells) Max. Activity | DRC Binding Flow 37° C.: AG000003284 (SKW3_4 expressing Vg9/Vd2) [CLI000001324 (C3819A)] Max. Activity | DRC Binding Flow 37° C.: AG000003287 (SKW3 expressing Vg9/Vd1) [CLI000001326 (C3821A)] Max. Activity | DRC Binding Flow 37° C.: AG000003285 (SKW3 expressing Vg5/Vd2) [CLI000001325 (C3820A)] Max. Activity |
| 75 | VG9B194 | Vd2 | 2470.37 | 151.47 | 6.29 | 148.31 |
| 76 | VG9B182 | Vd2 | 2365.20 | 159.31 | 1.68 | 195.27 |
| 77 | VG9B173 | Vd2 | 2362.86 | 181.80 | 1.82 | 25.36 |
| 78 | VG9B87 | Vd2 | 2331.26 | 138.98 | 1.40 | 51.63 |
| 79 | VG9B208 | Vd2 | 2306.11 | 176.93 | 2.15 | 203.33 |
| 80 | VG9B372 | Vd2 | 2293.95 | 127.30 | 1.02 | 171.26 |
| 81 | VG9B186 | Vd2 | 2287.42 | 142.50 | 1.20 | 66.88 |
| 82 | VG9B177 | Vd2 | 2247.18 | 161.00 | 1.28 | 192.81 |
| 83 | VG9B114 | Vd2 | 1975.60 | 176.44 | 8.38 | 226.28 |
| 84 | VG9B147 | Vd2 | 1890.32 | 30.48 | 1.59 | 69.75 |
| 85 | VG9B65 | Vd2 | 1819.09 | 88.75 | 8.50 | 122.51 |
| 86 | VG9B81 | Vd2 | 1771.18 | 42.23 | 1.17 | 77.02 |
| 87 | VG9B203 | Vd2 | 1753.37 | 143.32 | 1.30 | 193.78 |
| 88 | VG9B380 | Vd2 | 1749.32 | 163.87 | 11.60 | 232.97 |
| 89 | VG9B103 | Vd2 | 1675.38 | 96.41 | 1.79 | 236.84 |
| 90 | VG9B462 | Vd2 | 1541.64 | 140.24 | 21.55 | 141.65 |
| 91 | VG9B461 | Vd2 | 1539.12 | 148.91 | 9.04 | 153.18 |
| 92 | VG9B106 | Vd2 | 1524.56 | 10.48 | 1.20 | 64.28 |
| 93 | VG9B115 | Vd2 | 1522.89 | 41.89 | 1.49 | 66.95 |
| 94 | VG9B27 | Vd2 | 1446.95 | 137.76 | 5.83 | 208.79 |
| 95 | VG9B458 | Vd2 | 1412.02 | 147.86 | 4.38 | 123.29 |
| 96 | VG9B131 | Vd2 | 1403.08 | 58.11 | 2.38 | 91.72 |
| 97 | VG9B163 | Vd2 | 1346.41 | 57.19 | 10.63 | 48.91 |
| 98 | VG9B454 | Vd2 | 1244.69 | 180.68 | 29.37 | 158.37 |
| 99 | VG9B439 | Vd2 | 1244.61 | 169.53 | 1.84 | 162.87 |
| 100 | VG9B68 | Vd2 | 1192.87 | 124.09 | 2.08 | 207.12 |
| 101 | VG9B449 | Vd2 | 1178.94 | 164.57 | 1.47 | 158.60 |
| 102 | VG9B204 | Vd2 | 1129.50 | 99.65 | 1.50 | 169.49 |
| 103 | VG9B459 | Vd2 | 1087.45 | 156.84 | 7.55 | 137.62 |
| 104 | VG9B157 | Vd2 | 1070.92 | 10.96 | 0.96 | 11.69 |
| 105 | VG9B453 | Vd2 | 1037.24 | 171.23 | 1.69 | 162.89 |
| 106 | VG9B443 | Vd2 | 1005.02 | 171.26 | 5.90 | 150.44 |
| 107 | VG9B455 | Vd2 | 1000.40 | 169.15 | 1.33 | 153.89 |
| 108 | VG9B466 | Vd2 | 945.82 | 139.31 | 1.76 | 126.03 |
| 109 | VG9B450 | Vd2 | 927.78 | 167.57 | 1.13 | 159.63 |
| 110 | VG9B438 | Vd2 | 895.07 | 164.78 | 1.74 | 165.98 |
| 111 | VG9B464 | Vd2 | 886.16 | 145.74 | 1.73 | 115.48 |
| 112 | VG9B437 | Vd2 | 885.19 | 164.62 | 1.30 | 153.25 |
| 113 | VG9B457 | Vd2 | 864.60 | 179.57 | 0.93 | 157.79 |
| 114 | VG9B442 | Vd2 | 856.24 | 159.04 | 1.48 | 158.00 |
| 115 | VG9B436 | Vd2 | 812.47 | 162.02 | 1.88 | 169.69 |
| 116 | VG9B434 | Vd2 | 803.78 | 171.06 | 1.48 | 159.57 |
| 117 | VG9B460 | Vd2 | 767.37 | 138.23 | 1.47 | 129.82 |
| 118 | VG9B189 | Vd2 | 738.68 | 46.15 | 1.46 | 21.54 |
| 119 | VG9B452 | Vd2 | 686.75 | 181.12 | 2.10 | 166.55 |
| 120 | VG9B53 | Vd2 | 536.30 | 7.34 | 0.93 | 109.60 |
| 121 | VG9B41 | Vd2 | 137.19 | 11.43 | 2.18 | 16.08 |
| 122 | VG9B136 | g/d constant | 2684.58 | 180.54 | 288.27 | 226.18 |
| 123 | VG9B399 | g/d constant | 2478.03 | 214.03 | 435.82 | 206.50 |
| 124 | VG9B369 | g/d constant | 2429.10 | 258.91 | 319.93 | 241.30 |
| 125 | VG9B144 | g/d constant | 2425.86 | 123.44 | 204.70 | 193.74 |
| 126 | VG9B410 | g/d constant | 2253.41 | 222.69 | 434.89 | 54.42 |
| 127 | VG9B386 | g/d constant | 2113.79 | 210.54 | 388.92 | 92.74 |
| 128 | VG9B125 | g/d constant | 1992.68 | 126.84 | 277.32 | 194.19 |
| 129 | VG9B112 | g/d constant | 1991.02 | 227.15 | 328.28 | 217.02 |
| 130 | VG9B371 | g/d constant | 1970.39 | 225.19 | 430.68 | 130.30 |
| 131 | VG9B387 | g/d constant | 1965.44 | 200.61 | 434.64 | 261.40 |
| 132 | VG9B47 | g/d constant | 1558.28 | 162.35 | 308.26 | 211.59 |
| 133 | VG9B379 | g/d constant | 1458.49 | 160.15 | 294.95 | 260.37 |
| 134 | VG9B447 | g/d constant | 1417.79 | 196.00 | 94.00 | 161.41 |
| 135 | VG9B392 | g/d constant | 1247.94 | 154.25 | 295.22 | 281.15 |
| 136 | VG9B96 | g/d constant | 1022.01 | 126.04 | 244.90 | 223.89 |
| 137 | VG9B77 | g/d constant | 771.90 | 102.46 | 137.09 | 147.80 |

Cytokine and effector molecule analysis. Cytokines and effector molecules were assessed both intracellularly and in the cell culture supernatants. For intracellular cytokine and effector molecules assessment by flow cytometry, cells were initially surface stained with indicated monoclonal antibodies and washed twice with wash buffer. Stained cells were fixed and permeabilized using BD Fix/Perm kit (BD biosciences) per manufacturer's instructions. Permeabilized cells were probed with monoclonal antibodies against intracellular cytokines (TNFα, IFNγ) or effector molecules (Granzyme B) for 30 minutes at 4° C. Cells were washed twice and acquired on Novocyte flow cytometer. FMO (Fluorescence Minus One) controls were used to establish the gating for cytokines. For assessing cytokines in cell culture supernatant, cell culture supernatants were collected on indicated time points and subjected to quantification using customized human magnetic Luminex assay 15-plex kit (R&D Systems, Minneapolis, USA), as per the manufacturer's instructions. Quantification of the cytokines was carried out in MAGPIX multiplex detection system with xPONENT software. Results are shown in Table 9.

Activated T Cell Surface Marker Profiles. Flow cytometery was utilized to asses the percentage of Vγ9+ cells expressing certain T cell activation markers, including CD25 and CD71 expression, as well as the percentage of Vγ9 T cells in the cell population. Briefly, 48-well plates were coated with 200 μl of antibodies (1 μg/ml) and control antibody (VG7A5 1 μg/ml) in PBS overnight at 40° C. PBMCs were thawed and resuspended in RPMI+10% FBS media. They were then labeled with CTV dye to track proliferation. CTV labeled PBMCs were plated $2 \times 10^6$ in 250 μl media per well of the antibody coated plates and incubated at 37° C. for 2 days. Supernatant was collected on day 2 for Luminex analysis (IFNγ, TNFα, Granzyme B). The cells were spun down and transferred to IL-2 containing media (100 IU/ml) and allowed to rest for 3 days followed by staining for CD25, CD71, IFNγ and Granzyme B after 3 days. The results are shown in Table 9.

TABLE 9

Cell Cytokine and Surface Marker Profiles

| | Protein | Luminex (supernatant) | | | | Flow Staining | | |
| --- | --- | --- | --- | --- | --- | --- | --- | --- |
| # | Name | TNFα | IL6 | IFNγ | Granzyme B | CD25+ (Vg9+ cells) | CD71+ (Vg9+ cells) | Vg9 T cell % |
| 1 | VG9B54 | 6096 | 761 | 1601 | 3103 | 32.4 | 93.3 | 10.5 |
| 2 | VG9B121 | 96 | 161 | 429 | 1352 | 50.9 | 98.7 | 16.1 |
| 3 | VG9B429 | 583 | 816 | 1249 | 2148 | 25.8 | 91.6 | 3.0 |
| 4 | VG9B370 | 2297 | 541 | 2839 | 5023 | 44.9 | 98.6 | 8.0 |
| 5 | VG9B80 | 4914 | 385 | 1364 | 3009 | 49.6 | 98.3 | 5.2 |
| 6 | VG9B414 | 186 | 219 | 476 | 1489 | 24.8 | 88.1 | 4.0 |
| 7 | VG9B195 | 61 | 166 | 303 | 1064 | 15.8 | 86.9 | 3.7 |
| 8 | VG9B140 | 3517 | 602 | 796 | 2161 | 20.4 | 70.6 | 3.9 |
| 9 | VG9B426 | 789 | 621 | 2348 | 4586 | 36.5 | 98.8 | 7.6 |
| 10 | VG9B46 | 5256 | 375 | 1154 | 3174 | 37.9 | 95.8 | 4.4 |
| 11 | VG9B416 | 87 | 225 | 1175 | 3390 | 46.4 | 98.8 | 13.9 |
| 12 | VG9B69 | 1099 | 591 | 2070 | 3238 | 40.4 | 97.7 | 8.8 |
| 13 | VG9B415 | 193 | 403 | 1213 | 5157 | 31.5 | 96.9 | 5.3 |
| 14 | VG9B104 | 4132 | 1092 | 2441 | 5290 | 41.4 | 95.2 | 5.1 |
| 15 | VG9B198 | 66 | 199 | 324 | 1103 | 23.0 | 91.2 | 3.6 |
| 16 | VG9B463 | 2109 | 100 | 364 | 965 | 26.0 | 87.4 | 4.1 |
| 17 | VG9B469 | 173 | 440 | 1585 | 3696 | 29.9 | 98.5 | 7.8 |
| 18 | VG9B428 | 390 | 613 | 1995 | 4125 | 37.0 | 98.1 | 5.0 |
| 19 | VG9B430 | 125 | 372 | 1491 | 2515 | 37.5 | 96.2 | 10.7 |
| 20 | VG9B423 | 229 | 590 | 1432 | 3376 | 40.3 | 98.9 | 13.9 |
| 21 | VG9B98 | 2007 | 294 | 305 | 1424 | 29.4 | 90.5 | 7.2 |
| 22 | VG9B73 | 136 | 359 | 1051 | 3372 | 30.6 | 94.1 | 13.8 |
| 23 | VG9B133 | 123 | 478 | 1167 | 3475 | 21.8 | 91.4 | 5.8 |
| 24 | VG9B368 | 118 | 260 | 1484 | 3314 | 42.3 | 98.2 | 11.5 |
| 25 | VG9B424 | 174 | 931 | 1405 | 3964 | 36.7 | 98.8 | 12.1 |
| 26 | VG9B427 | 220 | 340 | 2487 | 4676 | 50.6 | 99.1 | 13.6 |
| 27 | VG9B417 | 202 | 1409 | 2873 | 5568 | 49.6 | 98.8 | 10.9 |
| 28 | VG9B58 | 3454 | 572 | 1599 | 3839 | 33.9 | 91.8 | 6.8 |
| 29 | VG9B419 | 216 | 362 | 2429 | 4250 | 34.2 | 98.1 | 5.0 |
| 30 | VG9B425 | 127 | 612 | 1356 | 3740 | 39.3 | 98.6 | 15.6 |
| 31 | VG9B143 | 32 | 113 | 155 | 1086 | 11.4 | 87.5 | 6.2 |
| 32 | VG9B418 | 163 | 279 | 2182 | 3886 | 46.9 | 99.2 | 13.3 |
| 33 | VG9B472 | 84 | 394 | 575 | 2780 | 23.4 | 96.6 | 6.3 |
| 34 | VG9B421 | 255 | 604 | 2454 | 6129 | 36.7 | 98.7 | 7.1 |
| 35 | VG9B88 | 1263 | 551 | 1531 | 2377 | 15.1 | 88.1 | 4.1 |
| 36 | VG9B384 | 3744 | 610 | 1099 | 2301 | 26.4 | 89.9 | 3.4 |
| 37 | VG9B413 | 229 | 1961 | 2830 | 5795 | 44.9 | 98.8 | 13.3 |
| 38 | VG9B36 | 188 | 607 | 2581 | 3893 | 29.1 | 89.4 | 7.8 |
| 39 | VG9B403 | 102 | 175 | 1388 | 3017 | 36.2 | 97.5 | 7.2 |
| 40 | VG9B191 | 7323 | 400 | 1385 | 3373 | 42.4 | 93.6 | 5.2 |
| 41 | VG9B44 | 198 | 587 | 1147 | 3031 | 45.4 | 98.8 | 14.4 |
| 42 | VG9B67 | 144 | 365 | 972 | 2553 | 28.5 | 87.4 | 14.0 |
| 43 | VG9B402 | 376 | 433 | 2367 | 4497 | 45.5 | 99.1 | 9.5 |
| 44 | VG9B127 | 709 | 348 | 1173 | 2453 | 37.3 | 96.5 | 11.2 |
| 45 | VG9B137 | 30 | 8 | 44 | 36 | 8.7 | 77.3 | 3.6 |
| 46 | VG9B33 | 85 | 240 | 749 | 1994 | 28.0 | 95.2 | 14.0 |
| 47 | VG9B162 | 329 | 54 | 57 | 481 | 9.7 | 70.3 | 2.7 |

TABLE 9-continued

Cell Cytokine and Surface Marker Profiles

| | Protein | Luninex (supernatant) | | | | Flow Staining | | |
| --- | --- | --- | --- | --- | --- | --- | --- | --- |
| | | | | | | CD25+ | CD71+ | Vg9 T |
| # | Name | TNFα | IL6 | IFNγ | Granzyme B | (Vg9+ cells) | (Vg9+ cells) | cell % |
| 48 | VG9B152 | 51 | 118 | 344 | 1060 | 8.1 | 81.9 | 3.0 |
| 49 | VG9B64 | 46 | 122 | 383 | 863 | 21.4 | 79.6 | 4.0 |
| 50 | VG9B21 | 3329 | 459 | 1660 | 3153 | 27.5 | 91.8 | 7.1 |
| 51 | VG9B128 | 3964 | 304 | 1242 | 4854 | 36.6 | 97.4 | 9.6 |
| 52 | VG9B66 | 405 | 145 | 162 | 470 | 25.4 | 84.6 | 3.8 |
| 53 | VG9B32 | 10 | 11 | 44 | 68 | 19.1 | 87.3 | 5.1 |
| 54 | VG9B57 | 349 | 147 | 29 | 468 | 17.1 | 77.4 | 4.0 |
| 55 | VG9B135 | 225 | 717 | 57 | 270 | 20.6 | 77.7 | 4.3 |
| 56 | VG9B60 | 2425 | 269 | 280 | 912 | 9.1 | 73.0 | 2.9 |
| 57 | VG9B409 | 190 | 194 | 195 | 585 | 18.7 | 80.6 | 3.2 |
| 58 | VG9B411 | 25 | 88 | 51 | 115 | 10.8 | 75.4 | 3.0 |
| 59 | VG9B129 | 192 | 94 | 36 | 305 | 16.4 | 73.4 | 3.6 |
| 60 | VG9B396 | 908 | 172 | 531 | 1388 | 44.7 | 92.7 | 2.7 |
| 61 | VG9B470 | 3659 | 554 | 828 | 2231 | 43.5 | 92.6 | 2.3 |
| 62 | VG9B111 | 42 | 32 | 44 | 98 | 27.8 | 84.4 | 8.8 |
| 63 | VG9B169 | 722 | 399 | 577 | 2381 | 30.3 | 95.3 | 2.0 |
| 64 | VG9B639 | 6081 | 755 | 1397 | 4289 | 37.8 | 94.7 | 4.3 |
| 65 | VG9B201 | 460 | 77 | 225 | 987 | 21.8 | 89.4 | 4.2 |
| 66 | VG9B161 | 1285 | 286 | 620 | 1671 | 31.3 | 94.5 | 5.4 |
| 67 | VG9B383 | 687 | 379 | 1242 | 6027 | 29.7 | 91.3 | 6.4 |
| 68 | VG9B382 | 49 | 46 | 440 | 1640 | 32.7 | 93.9 | 6.0 |
| 69 | VG9B156 | 14 | 37 | 44 | 493 | 27.5 | 93.7 | 6.4 |
| 70 | VG9B205 | 224 | 66 | 99 | 800 | 22.0 | 91.4 | 2.4 |
| 71 | VG9B86 | 2254 | 186 | 503 | 1052 | 27.4 | 94.1 | 4.7 |
| 72 | VG9B154 | 9 | 4 | 44 | 181 | 26.3 | 93.7 | 6.9 |
| 73 | VG9B159 | 17 | 42 | 44 | 711 | 10.3 | 85.7 | 3.5 |
| 74 | VG9B465 | 132 | 126 | 795 | 1472 | 28.7 | 94.0 | 3.6 |
| 75 | VG9B194 | 276 | 40 | 44 | 316 | 17.0 | 82.6 | 3.7 |
| 76 | VG9B182 | 1040 | 209 | 938 | 2180 | 37.9 | 91.0 | 2.5 |
| 77 | VG9B173 | 17 | 104 | 83 | 766 | 22.9 | 90.4 | 5.1 |
| 78 | VG9B87 | 674 | 117 | 154 | 652 | 32.9 | 94.5 | 4.5 |
| 79 | VG9B208 | 22 | 31 | 68 | 618 | 16.8 | 91.7 | 3.8 |
| 80 | VG9B372 | 73 | 105 | 149 | 828 | 11.2 | 89.3 | 4.0 |
| 81 | VG9B186 | 429 | 56 | 68 | 327 | 13.3 | 78.3 | 3.4 |
| 82 | VG9B177 | 99 | 117 | 60 | 768 | 22.8 | 88.6 | 2.4 |
| 83 | VG9B114 | 6999 | 731 | 1081 | 3901 | 53.7 | 98.3 | 9.7 |
| 84 | VG9B147 | 58 | 81 | 44 | 307 | 12.0 | 89.0 | 3.0 |
| 85 | VG9B65 | 42 | 190 | 179 | 1040 | 24.6 | 96.4 | 7.2 |
| 86 | VG9B81 | 1147 | 144 | 138 | 500 | 27.4 | 79.7 | 8.4 |
| 87 | VG9B203 | 22 | 30 | 44 | 525 | 19.0 | 90.2 | 4.5 |
| 88 | VG9B380 | 15 | 21 | 44 | 228 | 15.5 | 84.3 | 4.2 |
| 89 | VG9B103 | 4760 | 298 | 889 | 3212 | 46.6 | 96.4 | 5.0 |
| 90 | VG9B462 | 7463 | 819 | 1461 | 2639 | 28.5 | 83.6 | 2.7 |
| 91 | VG9B461 | 7904 | 748 | 1353 | 3166 | 34.4 | 85.3 | 2.7 |
| 92 | VG9B106 | 119 | 39 | 44 | 287 | 12.2 | 73.9 | 3.5 |
| 93 | VG9B115 | 204 | 104 | 44 | 186 | 26.8 | 83.5 | 3.5 |
| 94 | VG9B27 | 3537 | 274 | 1492 | 4123 | 35.4 | 92.6 | 4.0 |
| 95 | VG9B458 | 4324 | 384 | 1026 | 2230 | 27.6 | 84.5 | 3.1 |
| 96 | VG9B131 | 371 | 76 | 91 | 429 | 18.8 | 80.3 | 3.4 |
| 97 | VG9B163 | 9 | 5 | 44 | 41 | 9.7 | 75.9 | 3.7 |
| 98 | VG9B454 | 2063 | 458 | 1215 | 2475 | 39.9 | 92.7 | 5.0 |
| 99 | VG9B439 | 190 | 140 | 167 | 760 | 13.8 | 86.0 | 3.9 |
| 100 | VG9B68 | 6831 | 539 | 1544 | 4204 | 35.6 | 93.5 | 9.3 |
| 101 | VG9B449 | 266 | 131 | 256 | 1089 | 16.3 | 87.2 | 3.5 |
| 102 | VG9B204 | 3255 | 230 | 698 | 1878 | 31.8 | 91.4 | 4.3 |
| 103 | VG9B459 | 1589 | 409 | 1060 | 2322 | 24.2 | 86.6 | 2.9 |
| 104 | VG9B157 | 74 | 606 | 36 | 115 | 13.1 | 78.3 | 3.3 |
| 105 | VG9B453 | 5756 | 612 | 1670 | 3297 | 29.7 | 87.9 | 3.0 |
| 106 | VG9B443 | 5106 | 860 | 1174 | 2548 | 33.6 | 86.0 | 3.8 |
| 107 | VG9B455 | 7052 | 1576 | 2726 | 9278 | 24.2 | 77.3 | 2.6 |
| 108 | VG9B466 | 5870 | 558 | 1194 | 2375 | 21.7 | 84.6 | 2.6 |
| 109 | VG9B450 | 1510 | 293 | 560 | 1379 | 26.1 | 83.9 | 3.5 |
| 110 | VG9B438 | 1419 | 387 | 653 | 2365 | 28.2 | 86.4 | 4.2 |
| 111 | VG9B464 | 5479 | 392 | 1584 | 2486 | 26.6 | 86.2 | 3.3 |
| 112 | VG9B437 | 311 | 899 | 666 | 1489 | 20.4 | 85.4 | 3.7 |
| 113 | VG9B457 | 1201 | 1066 | 778 | 1836 | 24.0 | 83.2 | 3.4 |
| 114 | VG9B442 | 617 | 542 | 322 | 1306 | 18.4 | 82.0 | 3.9 |
| 115 | VG9B436 | 271 | 149 | 230 | 1080 | 21.5 | 87.0 | 3.9 |
| 116 | VG9B434 | 478 | 985 | 900 | 4803 | 20.5 | 85.3 | 4.2 |
| 117 | VG9B460 | 333 | 528 | 410 | 1252 | 18.5 | 88.0 | 3.2 |
| 118 | VG9B189 | 64 | 30 | 44 | 230 | 11.6 | 80.0 | 3.5 |
| 119 | VG9B452 | 1891 | 273 | 1037 | 1828 | 26.4 | 84.9 | 3.6 |

TABLE 9-continued

Cell Cytokine and Surface Marker Profiles

| # | Protein Name | Luninex (supernatant) | | | | Flow Staining | | |
|---|---|---|---|---|---|---|---|---|
| | | TNFα | IL6 | IFNγ | Granzyme B | CD25+ (Vg9+ cells) | CD71+ (Vg9+ cells) | Vg9 T cell % |
| 120 | VG9B53 | 9 | 17 | 44 | 125 | 10.8 | 81.4 | 3.7 |
| 121 | VG9B41 | 213 | 95 | 29 | 274 | 16.9 | 79.5 | 4.8 |
| 122 | VG9B136 | 192 | 279 | 560 | 1542 | 33.3 | 94.9 | 5.7 |
| 123 | VG9B399 | 157 | 511 | 2400 | 8239 | 36.8 | 96.5 | 7.0 |
| 124 | VG9B369 | 138 | 4897 | 1458 | 2633 | 27.1 | 92.4 | 6.1 |
| 125 | VG9B144 | 215 | 123 | 352 | 1762 | 20.6 | 89.6 | 3.8 |
| 126 | VG9B410 | 158 | 590 | 2119 | 4389 | 36.5 | 98.2 | 12.3 |
| 127 | VG9B386 | 89 | 228 | 846 | 2963 | 29.7 | 97.0 | 8.5 |
| 128 | VG9B125 | 959 | 587 | 1491 | 3755 | 24.8 | 70.8 | 12.4 |
| 129 | VG9B112 | 1255 | 256 | 461 | 1143 | 23.4 | 91.8 | 7.9 |
| 130 | VG9B371 | 4097 | 1555 | 4834 | 7484 | 42.3 | 98.4 | 8.2 |
| 131 | VG9B387 | 135 | 5196 | 746 | 1471 | 24.7 | 89.7 | 5.5 |
| 132 | VG9B47 | 73 | 293 | 383 | 1284 | 30.0 | 96.1 | 6.4 |
| 133 | VG9B379 | 258 | 465 | 710 | 2529 | 29.9 | 94.7 | 7.7 |
| 134 | VG9B447 | 1539 | 197 | 462 | 1303 | 23.3 | 84.6 | 3.4 |
| 135 | VG9B392 | 78 | 191 | 258 | 1548 | 21.2 | 96.5 | 7.6 |
| 136 | VG9B96 | 3808 | 4354 | 2690 | 7663 | 33.1 | 82.5 | 15.1 |
| 137 | VG9B77 | 195 | 864 | 787 | 4675 | 19.4 | 90.3 | 5.1 |

It will be appreciated by those skilled in the art that changes could be made to the embodiments described above without departing from the broad inventive concept thereof. It is understood, therefore, that this invention is not limited to the particular embodiments disclosed, but it is intended to cover modifications within the spirit and scope of the present invention as defined by the present description.

SEQUENCE LISTING (4660 sequences)

SEQ ID NO: 1 - protein, 5 aa, Artificial Sequence
  Description of Artificial Sequence: Synthetic peptide
SYSLT

SEQ ID NO: 2 - protein, 17 aa, Artificial Sequence
  Description of Artificial Sequence: Synthetic peptide
SISSSSSYIFYADSVKG

SEQ ID NO: 3 - protein, 9 aa, Artificial Sequence
  Description of Artificial Sequence: Synthetic peptide
DGELGPFDY

SEQ ID NO: 4 - protein, 12 aa, Artificial Sequence
  Description of Artificial Sequence: Synthetic peptide
RASQSVSSSYLA

SEQ ID NO: 5 - protein, 7 aa, Artificial Sequence
  Description of Artificial Sequence: Synthetic peptide
GASSRAT

SEQ ID NO: 6 - protein, 9 aa, Artificial Sequence
  Description of Artificial Sequence: Synthetic peptide
QQYGRSPLT

SEQ ID NO: 7 - protein, 7 aa, Artificial Sequence
  Description of Artificial Sequence: Synthetic peptide
GFAFSSY

SEQ ID NO: 8 - protein, 6 aa, Artificial Sequence
  Description of Artificial Sequence: Synthetic peptide
SSSSSY

SEQ ID NO: 9 - protein, 8 aa, Artificial Sequence
  Description of Artificial Sequence: Synthetic peptide
DGELGPFD

SEQ ID NO: 10 - protein, 8 aa, Artificial Sequence
  Description of Artificial Sequence: Synthetic peptide
SQSVSSSY

SEQ ID NO: 11 - protein, 3 aa, Artificial Sequence
  Description of Artificial Sequence: Synthetic peptide
GAS

SEQ ID NO: 12 - protein, 6 aa, Artificial Sequence
  Description of Artificial Sequence: Synthetic peptide
YGRSPL

SEQ ID NO: 13 - protein, 10 aa, Artificial Sequence
  Description of Artificial Sequence: Synthetic peptide
GFAFSSYSLT

SEQ ID NO: 14 - protein, 10 aa, Artificial Sequence
  Description of Artificial Sequence: Synthetic peptide
SISSSSSYIF

SEQ ID NO: 15 - protein, 9 aa, Artificial Sequence
  Description of Artificial Sequence: Synthetic peptide
DGELGPFDY

SEQ ID NO: 16 - protein, 12 aa, Artificial Sequence
  Description of Artificial Sequence: Synthetic peptide
RASQSVSSSYLA

SEQ ID NO: 17 - protein, 7 aa, Artificial Sequence
  Description of Artificial Sequence: Synthetic peptide
GASSRAT

SEQ ID NO: 18 - protein, 9 aa, Artificial Sequence
  Description of Artificial Sequence: Synthetic peptide
QQYGRSPLT

SEQ ID NO: 19 - protein, 6 aa, Artificial Sequence
  Description of Artificial Sequence: Synthetic peptide
SSYSLT

SEQ ID NO: 20 - protein, 13 aa, Artificial Sequence
  Description of Artificial Sequence: Synthetic peptide
WVSSISSSSSYIF

SEQ ID NO: 21 - protein, 10 aa, Artificial Sequence
  Description of Artificial Sequence: Synthetic peptide
ATDGELGPFD

SEQ ID NO: 22 - protein, 8 aa, Artificial Sequence
  Description of Artificial Sequence: Synthetic peptide
SSSYLAWF

SEQ ID NO: 23 - protein, 10 aa, Artificial Sequence
  Description of Artificial Sequence: Synthetic peptide
RLIYGASSRA

SEQ ID NO: 24 - protein, 8 aa, Artificial Sequence
  Description of Artificial Sequence: Synthetic peptide
QQYGRSPL

SEQ ID NO: 25 - protein, 8 aa, Artificial Sequence
  Description of Artificial Sequence: Synthetic peptide
GFAFSSYS

SEQ ID NO: 26 - protein, 8 aa, Artificial Sequence
  Description of Artificial Sequence: Synthetic peptide
ISSSSSYI

SEQ ID NO: 27 - protein, 11 aa, Artificial Sequence
  Description of Artificial Sequence: Synthetic peptide
ATDGELGPFDY

SEQ ID NO: 28 - protein, 7 aa, Artificial Sequence
  Description of Artificial Sequence: Synthetic peptide
QSVSSSY

SEQ ID NO: 29 - protein, 3 aa, Artificial Sequence
  Description of Artificial Sequence: Synthetic peptide
GAS

SEQ ID NO: 30 - protein, 9 aa, Artificial Sequence
  Description of Artificial Sequence: Synthetic peptide
QQYGRSPLT

SEQ ID NO: 31 - protein, 118 aa, Artificial Sequence
  Description of Artificial Sequence: Synthetic polypeptide
EVQLVESGGGLVKPGGSLRLSCAASGFAFSSYSLTWVRQAPGKGLEWVSSISSSSSYIFYADSVKGRFTISRDNAKNSLYLQMNSLRAEDTAVYYCATDGELGPFDYWGQGTTVTVSS

SEQ ID NO: 32 - protein, 108 aa, Artificial Sequence
  Description of Artificial Sequence: Synthetic polypeptide
EIVMTQSPGTLSLSPGERATLSCRASQSVSSSYLAWFQQKPGQAPRRLIYGASSRATGIPDRFSGSGSGTDFTLTISRLEPEDFAVYYCQQYGRSPLTFGGGTKVEIK

SEQ ID NO: 33 - protein, 448 aa, Artificial Sequence
  Description of Artificial Sequence: Synthetic polypeptide
EVQLVESGGGLVKPGGSLRLSCAASGFAFSSYSLTWVRQAPGKGLEWVSSISSSSSYIFYADSVKGRFTISRDNAKNSLYLQMNSLRAEDTAVYYCATDGELGPFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 215 aa, Artificial Sequence
  Description of Artificial Sequence: Synthetic polypeptide
EIVMTQSPGTLSLSPGERATLSCRASQSVSSSYLAWFQQKPGQAPRRLIYGASSRATGIPDRFSGSGSGTDFTLTISRLEPEDFAVYYCQQYGRSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35 - protein, 5 aa, Artificial Sequence
  Description of Artificial Sequence: Synthetic peptide
DYAMD

SEQ ID NO: 36 - protein, 17 aa, Artificial Sequence
  Description of Artificial Sequence: Synthetic peptide
SISSTSNYIFYADSVKG

SEQ ID NO: 37 - protein, 12 aa, Artificial Sequence
  Description of Artificial Sequence: Synthetic peptide
SYNWNYGGAFDI

SEQ ID NO: 38 - protein, 12 aa, Artificial Sequence
  Description of Artificial Sequence: Synthetic peptide
RASQSVSSSYFA

SEQ ID NO: 39 - protein, 7 aa, Artificial Sequence
  Description of Artificial Sequence: Synthetic peptide
GASSRAT

SEQ ID NO: 40 - protein, 9 aa, Artificial Sequence
  Description of Artificial Sequence: Synthetic peptide
QQYGRSPLT

SEQ ID NO: 41 - protein, 7 aa, Artificial Sequence
  Description of Artificial Sequence: Synthetic peptide
GFTFSDY

SEQ ID NO: 42 - protein, 6 aa, Artificial Sequence
  Description of Artificial Sequence: Synthetic peptide
SSTSNY

SEQ ID NO: 43 - protein, 11 aa, Artificial Sequence
  Description of Artificial Sequence: Synthetic peptide
SYNWNYGGAFD

SEQ ID NO: 44 - protein, 8 aa, Artificial Sequence
  Description of Artificial Sequence: Synthetic peptide
SQSVSSSY

SEQ ID NO: 45 - protein, 3 aa, Artificial Sequence
  Description of Artificial Sequence: Synthetic peptide
GAS

SEQ ID NO: 46 - protein, 6 aa, Artificial Sequence
  Description of Artificial Sequence: Synthetic peptide
YGRSPL

SEQ ID NO: 47 - protein, 10 aa, Artificial Sequence
  Description of Artificial Sequence: Synthetic peptide
GFTFSDYAMD

SEQ ID NO: 48 - protein, 10 aa, Artificial Sequence
  Description of Artificial Sequence: Synthetic peptide
SISSTSNYIF

SEQ ID NO: 49 - protein, 12 aa, Artificial Sequence
  Description of Artificial Sequence: Synthetic peptide
SYNWNYGGAFDI

SEQ ID NO: 50 - protein, 12 aa, Artificial Sequence
  Description of Artificial Sequence: Synthetic peptide
RASQSVSSSYFA

SEQ ID NO: 51 - protein, 7 aa, Artificial Sequence
  Description of Artificial Sequence: Synthetic peptide
GASSRAT

SEQ ID NO: 52 - protein, 9 aa, Artificial Sequence
  Description of Artificial Sequence: Synthetic peptide
QQYGRSPLT

SEQ ID NO: 53 - protein, 6 aa, Artificial Sequence
  Description of Artificial Sequence: Synthetic peptide
SDYAMD

SEQ ID NO: 54 - protein, 13 aa, Artificial Sequence
  Description of Artificial Sequence: Synthetic peptide
WISSISSTSNYIF

SEQ ID NO: 55 - protein, 13 aa, Artificial Sequence
  Description of Artificial Sequence: Synthetic peptide
ANSYNWNYGGAFD

SEQ ID NO: 56 - protein, 8 aa, Artificial Sequence
  Description of Artificial Sequence: Synthetic peptide
SSSYFAWY

SEQ ID NO: 57 - protein, 10 aa, Artificial Sequence
  Description of Artificial Sequence: Synthetic peptide
LLIYGASSRA

SEQ ID NO: 58 - protein, 8 aa, Artificial Sequence
  Description of Artificial Sequence: Synthetic peptide
QQYGRSPL

SEQ ID NO: 59 - protein, 8 aa, Artificial Sequence
  Description of Artificial Sequence: Synthetic peptide
GFTFSDYA

SEQ ID NO: 60 - protein, 8 aa, Artificial Sequence
  Description of Artificial Sequence: Synthetic peptide
ISSTSNYI

SEQ ID NO: 61 - protein, 14 aa, Artificial Sequence
  Description of Artificial Sequence: Synthetic peptide
ANSYNWNYGGAFDI

SEQ ID NO: 62 - protein, 7 aa, Artificial Sequence
  Description of Artificial Sequence: Synthetic peptide
QSVSSSY

SEQ ID NO: 63 - protein, 3 aa, Artificial Sequence
  Description of Artificial Sequence: Synthetic peptide
GAS

SEQ ID NO: 64 - protein, 9 aa, Artificial Sequence
  Description of Artificial Sequence: Synthetic peptide
QQYGRSPLT

SEQ ID NO: 65 - protein, 121 aa, Artificial Sequence
  Description of Artificial Sequence: Synthetic polypeptide
EVQLVESGGGLVKPGGSLRLSCVASGFTFSDYAMDWVRQAPGKGLDWISSISSTSNYIFYADSVKGRFTISRDNAKNSLYLQMNSLRVEDSAVYYCANSYNWNYGGAFDIWGQGTMVTVSS

SEQ ID NO: 66 - protein, 108 aa, Artificial Sequence
  Description of Artificial Sequence: Synthetic polypeptide
DIQMTQSPGTLSSSPGERATLSCRASQSVSSSYFAWYQQKPGRAPRLLIYGASSRATGIPDRFSGSGSGTDFTLTISRLEPEDFAVYFCQQYGRSPLTFGGGTKVEIK

SEQ ID NO: 67 - protein, 451 aa, Artificial Sequence
  Description of Artificial Sequence: Synthetic polypeptide
EVQLVESGGGLVKPGGSLRLSCVASGFTFSDYAMDWVRQAPGKGLDWISSISSTSNYIFYADSVKGRFTISRDNAKNSLYLQMNSLRVEDSAVYYCANSYNWNYGGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 215 aa, Artificial Sequence
  Description of Artificial Sequence: Synthetic polypeptide
DIQMTQSPGTLSSSPGERATLSCRASQSVSSSYFAWYQQKPGRAPRLLIYGASSRATGIPDRFSGSGSGTDFTLTISRLEPEDFAVYFCQQYGRSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 69 - protein, 5 aa, Artificial Sequence
  Description of Artificial Sequence: Synthetic peptide
NYDMN

SEQ ID NO: 70 - protein, 17 aa, Artificial Sequence
  Description of Artificial Sequence: Synthetic peptide
SISSSSSYIYYADSVKG

SEQ ID NO: 71 - protein, 15 aa, Artificial Sequence
  Description of Artificial Sequence: Synthetic peptide
DVGVTTDYYYYGMDV

SEQ ID NO: 72 - protein, 11 aa, Artificial Sequence
  Description of Artificial Sequence: Synthetic peptide
RASQGINSWLA

SEQ ID NO: 73 - protein, 7 aa, Artificial Sequence
  Description of Artificial Sequence: Synthetic peptide
AASSLQS

SEQ ID NO: 74 - protein, 9 aa, Artificial Sequence
  Description of Artificial Sequence: Synthetic peptide
QQANSFPWT

SEQ ID NO: 75 - protein, 7 aa, Artificial Sequence
  Description of Artificial Sequence: Synthetic peptide
GFTFSNY

SEQ ID NO: 76 - protein, 6 aa, Artificial Sequence
  Description of Artificial Sequence: Synthetic peptide
SSSSSY

SEQ ID NO: 77 - protein, 14 aa, Artificial Sequence
  Description of Artificial Sequence: Synthetic peptide
DVGVTTDYYYYGMD

SEQ ID NO: 78 - protein, 7 aa, Artificial Sequence
  Description of Artificial Sequence: Synthetic peptide
SQGINSW

SEQ ID NO: 79 - protein, 3 aa, Artificial Sequence
  Description of Artificial Sequence: Synthetic peptide
AAS

SEQ ID NO: 80 - protein, 6 aa, Artificial Sequence
  Description of Artificial Sequence: Synthetic peptide
ANSFPW

SEQ ID NO: 81 - protein, 10 aa, Artificial Sequence
  Description of Artificial Sequence: Synthetic peptide
GFTFSNYDMN

SEQ ID NO: 82 - protein, 10 aa, Artificial Sequence
  Description of Artificial Sequence: Synthetic peptide
SISSSSSYIY

SEQ ID NO: 83 - protein, 15 aa, Artificial Sequence
  Description of Artificial Sequence: Synthetic peptide
DVGVTTDYYYYGMDV

SEQ ID NO: 84 - protein, 11 aa, Artificial Sequence
  Description of Artificial Sequence: Synthetic peptide
RASQGINSWLA

SEQ ID NO: 85 - protein, 7 aa, Artificial Sequence
  Description of Artificial Sequence: Synthetic peptide
AASSLQS

SEQ ID NO: 86 - protein, 9 aa, Artificial Sequence
  Description of Artificial Sequence: Synthetic peptide
QQANSFPWT

SEQ ID NO: 87 - protein, 6 aa, Artificial Sequence
  Description of Artificial Sequence: Synthetic peptide
SNYDMN

SEQ ID NO: 88 - protein, 13 aa, Artificial Sequence
  Description of Artificial Sequence: Synthetic peptide
WVSSISSSSSYIY

SEQ ID NO: 89 - protein, 16 aa, Artificial Sequence
  Description of Artificial Sequence: Synthetic peptide
ARDVGVTTDYYYYGMD

SEQ ID NO: 90 - protein, 7 aa, Artificial Sequence
  Description of Artificial Sequence: Synthetic peptide
NSWLAWY

SEQ ID NO: 91 - protein, 10 aa, Artificial Sequence
  Description of Artificial Sequence: Synthetic peptide
LLIYAASSLQ

SEQ ID NO: 92 - protein, 8 aa, Artificial Sequence
  Description of Artificial Sequence: Synthetic peptide
QQANSFPW

SEQ ID NO: 93 - protein, 8 aa, Artificial Sequence
  Description of Artificial Sequence: Synthetic peptide
GFTFSNYD

SEQ ID NO: 94 - protein, 8 aa, Artificial Sequence
  Description of Artificial Sequence: Synthetic peptide
ISSSSSYI

SEQ ID NO: 95 - protein, 17 aa, Artificial Sequence
  Description of Artificial Sequence: Synthetic peptide
ARDVGVTTDYYYYGMDV

SEQ ID NO: 96 - protein, 6 aa, Artificial Sequence
  Description of Artificial Sequence: Synthetic peptide
QGINSW

SEQ ID NO: 97 - protein, 3 aa, Artificial Sequence
  Description of Artificial Sequence: Synthetic peptide
AAS

SEQ ID NO: 98 - protein, 9 aa, Artificial Sequence
  Description of Artificial Sequence: Synthetic peptide
QQANSFPWT

SEQ ID NO: 99 - protein, 124 aa, Artificial Sequence
  Description of Artificial Sequence: Synthetic polypeptide
QVQLVQSGGGLVKPGGSLRLSCSASGFTFSNYDMNWVRQAPGKGLEWVSSISSSSSYIYYADSVKGRFTISRDNAKNSLYLQMNSLRAEDTAVYHCARDVGVTTDYYYYGMDVWGQGTMVTVSS

SEQ ID NO: 100 - protein, 107 aa, Artificial Sequence
  Description of Artificial Sequence: Synthetic polypeptide
DIQMTQSPSSVSASVGDRVTITCRASQGINSWLAWYQQKPGNAPKLLIYAASSLQSGVPSRFSGIGSGTDFIFTISSLQPEDFASYYCQQANSFPWTFGQGTRLEIK

SEQ ID NO: 101 - protein, 454 aa, Artificial Sequence
  Description of Artificial Sequence: Synthetic polypeptide
QVQLVQSGGGLVKPGGSLRLSCSASGFTFSNYDMNWVRQAPGKGLEWVSSISSSSSYIYYADSVKGRFTISRDNAKNSLYLQMNSLRAEDTAVYHCARDVGVTTDYYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 214 aa, Artificial Sequence
  Description of Artificial Sequence: Synthetic polypeptide
DIQMTQSPSSVSASVGDRVTITCRASQGINSWLAWYQQKPGNAPKLLIYAASSLQSGVPSRFSGIGSGTDFIFTISSLQPEDFASYYCQQANSFPWTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 103 - protein, 5 aa, Artificial Sequence
  Description of Artificial Sequence: Synthetic peptide
SYDMN

SEQ ID NO: 104 - protein, 17 aa, Artificial Sequence
  Description of Artificial Sequence: Synthetic peptide
SISSSSSYIYYADSVKG

SEQ ID NO: 105 - protein, 16 aa, Artificial Sequence
  Description of Artificial Sequence: Synthetic peptide
DRGVGGTDYYYYGLDV

SEQ ID NO: 106 - protein, 12 aa, Artificial Sequence
  Description of Artificial Sequence: Synthetic peptide
RASQSVSSSYLA

SEQ ID NO: 107 - protein, 7 aa, Artificial Sequence
  Description of Artificial Sequence: Synthetic peptide
GASSRAT

SEQ ID NO: 108 - protein, 10 aa, Artificial Sequence
  Description of Artificial Sequence: Synthetic peptide
QQYGSSPPYT

SEQ ID NO: 109 - protein, 7 aa, Artificial Sequence
  Description of Artificial Sequence: Synthetic peptide
RFTLSSY

SEQ ID NO: 110 - protein, 6 aa, Artificial Sequence
  Description of Artificial Sequence: Synthetic peptide
SSSSSY

SEQ ID NO: 111 - protein, 15 aa, Artificial Sequence
  Description of Artificial Sequence: Synthetic peptide
DRGVGGTDYYYYGLD

SEQ ID NO: 112 - protein, 8 aa, Artificial Sequence
  Description of Artificial Sequence: Synthetic peptide
SQSVSSSY

SEQ ID NO: 113 - protein, 3 aa, Artificial Sequence
  Description of Artificial Sequence: Synthetic peptide
GAS

SEQ ID NO: 114 - protein, 7 aa, Artificial Sequence
  Description of Artificial Sequence: Synthetic peptide
YGSSPPY

SEQ ID NO: 115 - protein, 10 aa, Artificial Sequence
  Description of Artificial Sequence: Synthetic peptide
RFTLSSYDMN

SEQ ID NO: 116 - protein, 10 aa, Artificial Sequence
  Description of Artificial Sequence: Synthetic peptide
SISSSSSYIY

SEQ ID NO: 117 - protein, 16 aa, Artificial Sequence
  Description of Artificial Sequence: Synthetic peptide
DRGVGGTDYYYYGLDV

SEQ ID NO: 118 - protein, 12 aa, Artificial Sequence
  Description of Artificial Sequence: Synthetic peptide
RASQSVSSSYLA

SEQ ID NO: 119 - protein, 7 aa, Artificial Sequence
  Description of Artificial Sequence: Synthetic peptide
GASSRAT

SEQ ID NO: 120 - protein, 10 aa, Artificial Sequence
  Description of Artificial Sequence: Synthetic peptide
QQYGSSPPYT

SEQ ID NO: 121 - protein, 6 aa, Artificial Sequence
  Description of Artificial Sequence: Synthetic peptide
SSYDMN

SEQ ID NO: 122 - protein, 13 aa, Artificial Sequence
  Description of Artificial Sequence: Synthetic peptide
WVSSISSSSSYIY

SEQ ID NO: 123 - protein, 17 aa, Artificial Sequence
  Description of Artificial Sequence: Synthetic peptide
ARDRGVGGTDYYYYGLD

SEQ ID NO: 124 - protein, 8 aa, Artificial Sequence
  Description of Artificial Sequence: Synthetic peptide
SSSYLAWY

SEQ ID NO: 125 - protein, 10 aa, Artificial Sequence
  Description of Artificial Sequence: Synthetic peptide
LLIYGASSRA

SEQ ID NO: 126 - protein, 9 aa, Artificial Sequence
  Description of Artificial Sequence: Synthetic peptide
QQYGSSPPY

SEQ ID NO: 127 - protein, 8 aa, Artificial Sequence
  Description of Artificial Sequence: Synthetic peptide
RFTLSSYD

SEQ ID NO: 128 - protein, 8 aa, Artificial Sequence
  Description of Artificial Sequence: Synthetic peptide
ISSSSSYI

SEQ ID NO: 129 - protein, 18 aa, Artificial Sequence
  Description of Artificial Sequence: Synthetic peptide
ARDRGVGGTDYYYYGLDV

SEQ ID NO: 130 - protein, 7 aa, Artificial Sequence
  Description of Artificial Sequence: Synthetic peptide
QSVSSSY

SEQ ID NO: 131 - protein, 3 aa, Artificial Sequence
  Description of Artificial Sequence: Synthetic peptide
GAS

SEQ ID NO: 132 - protein, 10 aa, Artificial Sequence
  Description of Artificial Sequence: Synthetic peptide
QQYGSSPPYT

SEQ ID NO: 133 - protein, 125 aa, Artificial Sequence
  Description of Artificial Sequence: Synthetic polypeptide
EVQLVESGGGLVKPGGSLRLSCAASRFTLSSYDMNWVRQAPGKGLEWVSSISSSSSYIYYADSVKGRFTISRDNAKNSLYLQMNSLRAEDTAVYYCARDRGVGGTDYYYYGLDVWGQGTTVTVSS

SEQ ID NO: 134 - protein, 109 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPYTFGQGTKVEIK

SEQ ID NO: 135 - protein, 455 aa, Artificial Sequence
  Description of Artificial Sequence: Synthetic polypeptide
EVQLVESGGGLVKPGGSLRLSCAASRFTLSSYDMNWVRQAPGKGLEWVSSISSSSSYIYYADSVKGRFTISRDNAKNSLYLQMNSLRAEDTAVYYCARDRGVGGTDYYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 136 - protein, 216 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 137 - protein, 5 aa, Artificial Sequence
  Description of Artificial Sequence: Synthetic peptide
TYSMN

SEQ ID NO: 138 - protein, 17 aa, Artificial Sequence
  Description of Artificial Sequence: Synthetic peptide
SISSSSSYIFYADSVKG

SEQ ID NO: 139 - protein, 9 aa, Artificial Sequence
  Description of Artificial Sequence: Synthetic peptide
DGELGVFDY

SEQ ID NO: 140 - protein, 12 aa, Artificial Sequence
  Description of Artificial Sequence: Synthetic peptide
RASQSISSSYLA

SEQ ID NO: 141 - protein, 7 aa, Artificial Sequence
  Description of Artificial Sequence: Synthetic peptide
GPSGRAT

SEQ ID NO: 142 - protein, 9 aa, Artificial Sequence
  Description of Artificial Sequence: Synthetic peptide
QQFGRSPLT

SEQ ID NO: 143 - protein, 7 aa, Artificial Sequence
  Description of Artificial Sequence: Synthetic peptide
GFTFSTY

SEQ ID NO: 144 - protein, 6 aa, Artificial Sequence
  Description of Artificial Sequence: Synthetic peptide
SSSSSY

SEQ ID NO: 145 - protein, 8 aa, Artificial Sequence
  Description of Artificial Sequence: Synthetic peptide
DGELGVFD

SEQ ID NO: 146 - protein, 8 aa, Artificial Sequence
  Description of Artificial Sequence: Synthetic peptide
SQSISSSY

SEQ ID NO: 147 - protein, 3 aa, Artificial Sequence
  Description of Artificial Sequence: Synthetic peptide
GPS

SEQ ID NO: 148 - protein, 6 aa, Artificial Sequence
  Description of Artificial Sequence: Synthetic peptide
FGRSPL

SEQ ID NO: 149 - protein, 10 aa, Artificial Sequence
  Description of Artificial Sequence: Synthetic peptide
GFTFSTYSMN

SEQ ID NO: 150 - protein, 10 aa, Artificial Sequence
  Description of Artificial Sequence: Synthetic peptide
SISSSSSYIF

SEQ ID NO: 151 - protein, 9 aa, Artificial Sequence
  Description of Artificial Sequence: Synthetic peptide
DGELGVFDY

SEQ ID NO: 152 - protein, 12 aa, Artificial Sequence
  Description of Artificial Sequence: Synthetic peptide
RASQSISSSYLA

SEQ ID NO: 153 - protein, 7 aa, Artificial Sequence
  Description of Artificial Sequence: Synthetic peptide
GPSGRAT

SEQ ID NO: 154 - protein, 9 aa, Artificial Sequence
  Description of Artificial Sequence: Synthetic peptide
QQFGRSPLT

SEQ ID NO: 155 - protein, 6 aa, Artificial Sequence
  Description of Artificial Sequence: Synthetic peptide
STYSMN

SEQ ID NO: 156 - protein, 13 aa, Artificial Sequence
  Description of Artificial Sequence: Synthetic peptide
WVSSISSSSSYIF

SEQ ID NO: 157 - protein, 10 aa, Artificial Sequence
  Description of Artificial Sequence: Synthetic peptide
AKDGELGVFD

SEQ ID NO: 158 - protein, 8 aa, Artificial Sequence
  Description of Artificial Sequence: Synthetic peptide
SSSYLAWY

SEQ ID NO: 159 - protein, 10 aa, Artificial Sequence
  Description of Artificial Sequence: Synthetic peptide
VLIYGPSGRA

SEQ ID NO: 160 - protein, 8 aa, Artificial Sequence
  Description of Artificial Sequence: Synthetic peptide
QQFGRSPL

SEQ ID NO: 161 - protein, 8 aa, Artificial Sequence
  Description of Artificial Sequence: Synthetic peptide
GFTFSTYS

SEQ ID NO: 162 - protein, 8 aa, Artificial Sequence
  Description of Artificial Sequence: Synthetic peptide
ISSSSSYI

SEQ ID NO: 163 - protein, 11 aa, Artificial Sequence
  Description of Artificial Sequence: Synthetic peptide
AKDGELGVFDY

SEQ ID NO: 164 - protein, 7 aa, Artificial Sequence
  Description of Artificial Sequence: Synthetic peptide
QSISSSY

SEQ ID NO: 165 - protein, 3 aa, Artificial Sequence
  Description of Artificial Sequence: Synthetic peptide
GPS

SEQ ID NO: 166 - protein, 9 aa, Artificial Sequence
  Description of Artificial Sequence: Synthetic peptide
QQFGRSPLT

SEQ ID NO: 167 - protein, 118 aa, Artificial Sequence
  Description of Artificial Sequence: Synthetic polypeptide
EVQLVQSGGGLVKSGGSLRLSCAASGFTFSTYSMNWVRQAPGKGLEWVSSISSSSSYIFYADSVKGRIIISRDNAKNSLYLQMNSVRADDTAVYYCAKDGELGVFDYWGQGTLVTVSS

SEQ ID NO: 168 - protein, 108 aa, Artificial Sequence
  Description of Artificial Sequence: Synthetic polypeptide
EIVLTQSPGTLSLSAGERATLSCRASQSISSSYLAWYQQKPGQAPRVLIYGPSGRATGIPDRFRGSGSGTDFTLTISRLEPEDFAVYYCQQFGRSPLTFGGGTKVEIK

SEQ ID NO: 169 - protein, 448 aa, Artificial Sequence
  Description of Artificial Sequence: Synthetic polypeptide
EVQLVQSGGGLVKSGGSLRLSCAASGFTFSTYSMNWVRQAPGKGLEWVSSISSSSSYIFYADSVKGRIIISRDNAKNSLYLQMNSVRADDTAVYYCAKDGELGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 170 - protein, 215 aa, Artificial Sequence
  Description of Artificial Sequence: Synthetic polypeptide
EIVLTQSPGTLSLSAGERATLSCRASQSISSSYLAWYQQKPGQAPRVLIYGPSGRATGIPDRFRGSGSGTDFTLTISRLEPEDFAVYYCQQFGRSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 171 - protein, 5 aa, Artificial Sequence
  Description of Artificial Sequence: Synthetic peptide
NYDMN

SEQ ID NO: 172 - protein, 17 aa, Artificial Sequence
  Description of Artificial Sequence: Synthetic peptide
SISSSSSYIYYADSVKG

SEQ ID NO: 173 - protein, 15 aa, Artificial Sequence
  Description of Artificial Sequence: Synthetic peptide
DVGVTTDYYYYGMDV

SEQ ID NO: 174 - protein, 11 aa, Artificial Sequence
  Description of Artificial Sequence: Synthetic peptide
RASQGINSWLA

SEQ ID NO: 175 - protein, 7 aa, Artificial Sequence
  Description of Artificial Sequence: Synthetic peptide
AASSLQS

SEQ ID NO: 176 - protein, 9 aa, Artificial Sequence
  Description of Artificial Sequence: Synthetic peptide
QQANSFPWT

SEQ ID NO: 177 - protein, 7 aa, Artificial Sequence
  Description of Artificial Sequence: Synthetic peptide
GFTFSNY

SEQ ID NO: 178 - protein, 6 aa, Artificial Sequence
  Description of Artificial Sequence: Synthetic peptide
SSSSSY

SEQ ID NO: 179 - protein, 14 aa, Artificial Sequence
  Description of Artificial Sequence: Synthetic peptide
DVGVTTDYYYYGMD

SEQ ID NO: 180 - protein, 7 aa, Artificial Sequence
  Description of Artificial Sequence: Synthetic peptide
SQGINSW

SEQ ID NO: 181 - protein, 3 aa, Artificial Sequence
  Description of Artificial Sequence: Synthetic peptide
AAS

SEQ ID NO: 182 - protein, 6 aa, Artificial Sequence
  Description of Artificial Sequence: Synthetic peptide
ANSFPW

SEQ ID NO: 183 - protein, 10 aa, Artificial Sequence
  Description of Artificial Sequence: Synthetic peptide
GFTFSNYDMN

SEQ ID NO: 184 - protein, 10 aa, Artificial Sequence
  Description of Artificial Sequence: Synthetic peptide
SISSSSSYIY

SEQ ID NO: 185 - protein, 15 aa, Artificial Sequence
  Description of Artificial Sequence: Synthetic peptide
DVGVTTDYYYYGMDV

SEQ ID NO: 186 - protein, 11 aa, Artificial Sequence
  Description of Artificial Sequence: Synthetic peptide
RASQGINSWLA

SEQ ID NO: 187 - protein, 7 aa, Artificial Sequence
  Description of Artificial Sequence: Synthetic peptide
AASSLQS

SEQ ID NO: 188 - protein, 9 aa, Artificial Sequence
  Description of Artificial Sequence: Synthetic peptide
QQANSFPWT

SEQ ID NO: 189 - protein, 6 aa, Artificial Sequence
  Description of Artificial Sequence: Synthetic peptide
SNYDMN

SEQ ID NO: 190 - protein, 13 aa, Artificial Sequence
  Description of Artificial Sequence: Synthetic peptide
WVSSISSSSSYIY

SEQ ID NO: 191 - protein, 16 aa, Artificial Sequence
  Description of Artificial Sequence: Synthetic peptide
ARDVGVTTDYYYYGMD

SEQ ID NO: 192 - protein, 7 aa, Artificial Sequence
  Description of Artificial Sequence: Synthetic peptide
NSWLAWY

SEQ ID NO: 193 - protein, 10 aa, Artificial Sequence
  Description of Artificial Sequence: Synthetic peptide
LLIYAASSLQ

SEQ ID NO: 194 - protein, 8 aa, Artificial Sequence
  Description of Artificial Sequence: Synthetic peptide
QQANSFPW

SEQ ID NO: 195 - protein, 8 aa, Artificial Sequence
  Description of Artificial Sequence: Synthetic peptide
GFTFSNYD

SEQ ID NO: 196 - protein, 8 aa, Artificial Sequence
  Description of Artificial Sequence: Synthetic peptide
ISSSSSYI

SEQ ID NO: 197 - protein, 17 aa, Artificial Sequence
  Description of Artificial Sequence: Synthetic peptide
ARDVGVTTDYYYYGMDV

SEQ ID NO: 198 - protein, 6 aa, Artificial Sequence
  Description of Artificial Sequence: Synthetic peptide
QGINSW

SEQ ID NO: 199 - protein, 3 aa, Artificial Sequence
  Description of Artificial Sequence: Synthetic peptide
AAS

SEQ ID NO: 200 - protein, 9 aa, Artificial Sequence
  Description of Artificial Sequence: Synthetic peptide
QQANSFPWT

SEQ ID NO: 201 - protein, 124 aa, Artificial Sequence
  Description of Artificial Sequence: Synthetic polypeptide
EVQLVESGGGLVKPGGSLRLSCSASGFTFSNYDMNWVRQAPGKGLEWVSSISSSSSYIYYADSVKGRFTISRDNAKNSLYLQMNSLRAEDTAVYHCARDVGVTTDYYYYGMDVWGQGTMVTVSS

SEQ ID NO: 202 - protein, 107 aa, Artificial Sequence
  Description of Artificial Sequence: Synthetic polypeptide
EIVMTQSPSSVSASVGDRVTITCRASQGINSWLAWYQQKPGNAPKLLIYAASSLQSGVPSRFSGIGSGTDFIFTISSLQPEDFASYYCQQANSFPWTFGQGTRLEIK

SEQ ID NO: 203 - protein, 454 aa, Artificial Sequence
  Description of Artificial Sequence: Synthetic polypeptide
EVQLVESGGGLVKPGGSLRLSCSASGFTFSNYDMNWVRQAPGKGLEWVSSISSSSSYIYYADSVKGRFTISRDNAKNSLYLQMNSLRAEDTAVYHCARDVGVTTDYYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204 - protein, 214 aa, Artificial Sequence
  Description of Artificial Sequence: Synthetic polypeptide
EIVMTQSPSSVSASVGDRVTITCRASQGINSWLAWYQQKPGNAPKLLIYAASSLQSGVPSRFSGIGSGTDFIFTISSLQPEDFASYYCQQANSFPWTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205 - protein, 5 aa, Artificial Sequence
  Description of Artificial Sequence: Synthetic peptide
PYTMN

SEQ ID NO: 206 - protein, 17 aa, Artificial Sequence
  Description of Artificial Sequence: Synthetic peptide
SISSSSSYMYYADSVKG

SEQ ID NO: 207 - protein, 13 aa, Artificial Sequence
  Description of Artificial Sequence: Synthetic peptide
DGDLVGPTYYFDY

SEQ ID NO: 208 - protein, 11 aa, Artificial Sequence
  Description of Artificial Sequence: Synthetic peptide
SGDKLGDKYAC

SEQ ID NO: 209 - protein, 7 aa, Artificial Sequence
  Description of Artificial Sequence: Synthetic peptide
QHNKRPS

SEQ ID NO: 210 - protein, 9 aa, Artificial Sequence
  Description of Artificial Sequence: Synthetic peptide
QAWDSTTVV

SEQ ID NO: 211 - protein, 7 aa, Artificial Sequence
  Description of Artificial Sequence: Synthetic peptide
GFTFSPY

SEQ ID NO: 212 - protein, 6 aa, Artificial Sequence
  Description of Artificial Sequence: Synthetic peptide
SSSSSY

SEQ ID NO: 213 - protein, 12 aa, Artificial Sequence
  Description of Artificial Sequence: Synthetic peptide
DGDLVGPTYYFD

SEQ ID NO: 214 - protein, 7 aa, Artificial Sequence
  Description of Artificial Sequence: Synthetic peptide
DKLGDKY

SEQ ID NO: 215 - protein, 3 aa, Artificial Sequence
  Description of Artificial Sequence: Synthetic peptide
QHN

SEQ ID NO: 216 - protein, 6 aa, Artificial Sequence
  Description of Artificial Sequence: Synthetic peptide
WDSTTV

SEQ ID NO: 217 - protein, 10 aa, Artificial Sequence
  Description of Artificial Sequence: Synthetic peptide
GFTFSPYTMN

SEQ ID NO: 218 - protein, 10 aa, Artificial Sequence
  Description of Artificial Sequence: Synthetic peptide
SISSSSSYMY

SEQ ID NO: 219 - protein, 13 aa, Artificial Sequence
  Description of Artificial Sequence: Synthetic peptide
DGDLVGPTYYFDY

SEQ ID NO: 220 - protein, 11 aa, Artificial Sequence
  Description of Artificial Sequence: Synthetic peptide
SGDKLGDKYAC

SEQ ID NO: 221 - protein, 7 aa, Artificial Sequence
  Description of Artificial Sequence: Synthetic peptide
QHNKRPS

SEQ ID NO: 222 - protein, 9 aa, Artificial Sequence
  Description of Artificial Sequence: Synthetic peptide
QAWDSTTVV

SEQ ID NO: 223 - protein, 6 aa, Artificial Sequence
  Description of Artificial Sequence: Synthetic peptide
SPYTMN

SEQ ID NO: 224 - protein, 13 aa, Artificial Sequence
  Description of Artificial Sequence: Synthetic peptide
WVSSISSSSSYMY

SEQ ID NO: 225 - protein, 14 aa, Artificial Sequence
  Description of Artificial Sequence: Synthetic peptide
ARDGDLVGPTYYFD

SEQ ID NO: 226 - protein, 7 aa, Artificial Sequence
  Description of Artificial Sequence: Synthetic peptide
DKYACWY

SEQ ID NO: 227 - protein, 10 aa, Artificial Sequence
  Description of Artificial Sequence: Synthetic peptide
LVIYQHNKRP

SEQ ID NO: 228 - protein, 8 aa, Artificial Sequence
  Description of Artificial Sequence: Synthetic peptide
QAWDSTTV

SEQ ID NO: 229 - protein, 8 aa, Artificial Sequence
  Description of Artificial Sequence: Synthetic peptide
GFTFSPYT

SEQ ID NO: 230 - protein, 8 aa, Artificial Sequence
  Description of Artificial Sequence: Synthetic peptide
ISSSSSYM

SEQ ID NO: 231 - protein, 15 aa, Artificial Sequence
  Description of Artificial Sequence: Synthetic peptide
ARDGDLVGPTYYFDY

SEQ ID NO: 232 - protein, 6 aa, Artificial Sequence
  Description of Artificial Sequence: Synthetic peptide
KLGDKY

SEQ ID NO: 233 - protein, 3 aa, Artificial Sequence
  Description of Artificial Sequence: Synthetic peptide
QHN

SEQ ID NO: 234 - protein, 9 aa, Artificial Sequence
  Description of Artificial Sequence: Synthetic peptide
QAWDSTTVV

SEQ ID NO: 235 - protein, 122 aa, Artificial Sequence
  Description of Artificial Sequence: Synthetic polypeptide
EVQLVESGGGLVKPGGSLRLSCAASGFTFSPYTMNWVRQAPGKGLEWVSSISSSSSYMYYADSVKGRFTISRDNAKNSLYLQMNSLRAEDTAVYYCARDGDLVGPTYYFDYWGQGTLVTVSS

SEQ ID NO: 236 - protein, 106 aa, Artificial Sequence
  Description of Artificial Sequence: Synthetic polypeptide
SYELMQPPSVSVSPGQTASITCSGDKLGDKYACWYQQKPGQSPVLVIYQHNKRPSGIPERFSGSNSGKTATLTISGTQAMDEADYYCQAWDSTTVVFGGGTKLTVL

SEQ ID NO: 237 - protein, 452 aa, Artificial Sequence
  Description of Artificial Sequence: Synthetic polypeptide
EVQLVESGGGLVKPGGSLRLSCAASGFTFSPYTMNWVRQAPGKGLEWVSSISSSSSYMYYADSVKGRFTISRDNAKNSLYLQMNSLRAEDTAVYYCARDGDLVGPTYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - protein, 212 aa, Artificial Sequence
  Description of Artificial Sequence: Synthetic polypeptide
SYELMQPPSVSVSPGQTASITCSGDKLGDKYACWYQQKPGQSPVLVIYQHNKRPSGIPERFSGSNSGKTATLTISGTQAMDEADYYCQAWDSTTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 239 - protein, 5 aa, Artificial Sequence
  Description of Artificial Sequence: Synthetic peptide
SYDMN

SEQ ID NO: 240 - protein, 17 aa, Artificial Sequence
  Description of Artificial Sequence: Synthetic peptide
SISTSSGYIYYADSVKG

SEQ ID NO: 241 - protein, 16 aa, Artificial Sequence
  Description of Artificial Sequence: Synthetic peptide
DRGIAVAGDYYYGMDV

SEQ ID NO: 242 - protein, 12 aa, Artificial Sequence
  Description of Artificial Sequence: Synthetic peptide
RASQSVSSSYLA

SEQ ID NO: 243 - protein, 7 aa, Artificial Sequence
  Description of Artificial Sequence: Synthetic peptide
GASSRAT

SEQ ID NO: 244 - protein, 10 aa, Artificial Sequence
  Description of Artificial Sequence: Synthetic peptide
QQYGSSPPYT

SEQ ID NO: 245 - protein, 7 aa, Artificial Sequence
  Description of Artificial Sequence: Synthetic peptide
GFTFRSY

SEQ ID NO: 246 - protein, 6 aa, Artificial Sequence
  Description of Artificial Sequence: Synthetic peptide
STSSGY

SEQ ID NO: 247 - protein, 15 aa, Artificial Sequence
  Description of Artificial Sequence: Synthetic peptide
DRGIAVAGDYYYGMD

SEQ ID NO: 248 - protein, 8 aa, Artificial Sequence
  Description of Artificial Sequence: Synthetic peptide
SQSVSSSY

SEQ ID NO: 249 - protein, 3 aa, Artificial Sequence
  Description of Artificial Sequence: Synthetic peptide
GAS

SEQ ID NO: 250 - protein, 7 aa, Artificial Sequence
  Description of Artificial Sequence: Synthetic peptide
YGSSPPY

SEQ ID NO: 251 - protein, 10 aa, Artificial Sequence
  Description of Artificial Sequence: Synthetic peptide
GFTFRSYDMN

SEQ ID NO: 252 - protein, 10 aa, Artificial Sequence
  Description of Artificial Sequence: Synthetic peptide
SISTSSGYIY

SEQ ID NO: 253 - protein, 16 aa, Artificial Sequence
  Description of Artificial Sequence: Synthetic peptide
DRGIAVAGDYYYGMDV

SEQ ID NO: 254 - protein, 12 aa, Artificial Sequence
  Description of Artificial Sequence: Synthetic peptide
RASQSVSSSYLA

SEQ ID NO: 255 - protein, 7 aa, Artificial Sequence
  Description of Artificial Sequence: Synthetic peptide
GASSRAT

SEQ ID NO: 256 - protein, 10 aa, Artificial Sequence
  Description of Artificial Sequence: Synthetic peptide
QQYGSSPPYT

SEQ ID NO: 257 - protein, 6 aa, Artificial Sequence
  Description of Artificial Sequence: Synthetic peptide
RSYDMN

SEQ ID NO: 258 - protein, 13 aa, Artificial Sequence
  Description of Artificial Sequence: Synthetic peptide
WVSSISTSSGYIY

SEQ ID NO: 259 - protein, 17 aa, Artificial Sequence
  Description of Artificial Sequence: Synthetic peptide
ARDRGIAVAGDYYYGMD

SEQ ID NO: 260 - protein, 8 aa, Artificial Sequence
  Description of Artificial Sequence: Synthetic peptide
SSSYLAWY

SEQ ID NO: 261 - protein, 10 aa, Artificial Sequence
  Description of Artificial Sequence: Synthetic peptide
LLIYGASSRA

SEQ ID NO: 262 - protein, 9 aa, Artificial Sequence
  Description of Artificial Sequence: Synthetic peptide
QQYGSSPPY

SEQ ID NO: 263 - protein, 8 aa, Artificial Sequence
  Description of Artificial Sequence: Synthetic peptide
GFTFRSYD

SEQ ID NO: 264 - protein, 8 aa, Artificial Sequence
  Description of Artificial Sequence: Synthetic peptide
ISTSSGYI

SEQ ID NO: 265 - protein, 18 aa, Artificial Sequence
  Description of Artificial Sequence: Synthetic peptide
ARDRGIAVAGDYYYGMDV

SEQ ID NO: 266 - protein, 7 aa, Artificial Sequence
  Description of Artificial Sequence: Synthetic peptide
QSVSSSY

SEQ ID NO: 267 - protein, 3 aa, Artificial Sequence
  Description of Artificial Sequence: Synthetic peptide
GAS

SEQ ID NO: 268 - protein, 10 aa, Artificial Sequence
  Description of Artificial Sequence: Synthetic peptide
QQYGSSPPYT

SEQ ID NO: 269 - protein, 125 aa, Artificial Sequence
  Description of Artificial Sequence: Synthetic polypeptide
EVQLVESGGGLVKPGGSLRLSCAGSGFTFRSYDMNWVRQAPGKGLEWVSSISTSSGYIYYADSVKGRFTISRDNAKNSLSLQMNSLRAEDTAVFYCARDRGIAVAGDYYYGMDVWGQGTMVTVSS

SEQ ID NO: 270 - protein, 109 aa, Artificial Sequence
  Description of Artificial Sequence: Synthetic polypeptide
EIVMTQSPGTLSLSPGERATLSCRASQSVSSSYLAWYQQKPGQAPRLLIYGASSRATGIPDRFSGSGSGTDFTLTISRLEAEDFAVYYCQQYGSSPPYTFGQGTKVEIK

SEQ ID NO: 271 - protein, 455 aa, Artificial Sequence
  Description of Artificial Sequence: Synthetic polypeptide
EVQLVESGGGLVKPGGSLRLSCAGSGFTFRSYDMNWVRQAPGKGLEWVSSISTSSGYIYYADSVKGRFTISRDNAKNSLSLQMNSLRAEDTAVFYCARDRGIAVAGDYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 272 - protein, 216 aa, Artificial Sequence
  Description of Artificial Sequence: Synthetic polypeptide
EIVMTQSPGTLSLSPGERATLSCRASQSVSSSYLAWYQQKPGQAPRLLIYGASSRATGIPDRFSGSGSGTDFTLTISRLEAEDFAVYYCQQYGSSPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 273 - protein, 5 aa, Artificial Sequence
  Description of Artificial Sequence: Synthetic peptide
NYDMN

SEQ ID NO: 274 - protein, 17 aa, Artificial Sequence
  Description of Artificial Sequence: Synthetic peptide
SISSSSSYIYYADSVKG

SEQ ID NO: 275 - protein, 15 aa, Artificial Sequence
  Description of Artificial Sequence: Synthetic peptide
DVGVTTDYYYYGMDV

SEQ ID NO: 276 - protein, 12 aa, Artificial Sequence
  Description of Artificial Sequence: Synthetic peptide
RASQSVASSYLA

SEQ ID NO: 277 - protein, 7 aa, Artificial Sequence
  Description of Artificial Sequence: Synthetic peptide
GASSRAT

SEQ ID NO: 278 - protein, 10 aa, Artificial Sequence
  Description of Artificial Sequence: Synthetic peptide
QQYGSSPPYT

SEQ ID NO: 279 - protein, 7 aa, Artificial Sequence
  Description of Artificial Sequence: Synthetic peptide
GFTFSNY

SEQ ID NO: 280 - protein, 6 aa, Artificial Sequence
  Description of Artificial Sequence: Synthetic peptide
SSSSSY

SEQ ID NO: 281 - protein, 14 aa, Artificial Sequence
  Description of Artificial Sequence: Synthetic peptide
DVGVTTDYYYYGMD

SEQ ID NO: 282 - protein, 8 aa, Artificial Sequence
  Description of Artificial Sequence: Synthetic peptide
SQSVASSY

SEQ ID NO: 283 - protein, 3 aa, Artificial Sequence
  Description of Artificial Sequence: Synthetic peptide
GAS

SEQ ID NO: 284 - protein, 7 aa, Artificial Sequence
  Description of Artificial Sequence: Synthetic peptide
YGSSPPY

SEQ ID NO: 285 - protein, 10 aa, Artificial Sequence
  Description of Artificial Sequence: Synthetic peptide
GFTFSNYDMN

SEQ ID NO: 286 - protein, 10 aa, Artificial Sequence
  Description of Artificial Sequence: Synthetic peptide
SISSSSSYIY

SEQ ID NO: 287 - protein, 15 aa, Artificial Sequence
  Description of Artificial Sequence: Synthetic peptide
DVGVTTDYYYYGMDV

SEQ ID NO: 288 - protein, 12 aa, Artificial Sequence
  Description of Artificial Sequence: Synthetic peptide
RASQSVASSYLA

SEQ ID NO: 289 - protein, 7 aa, Artificial Sequence
  Description of Artificial Sequence: Synthetic peptide
GASSRAT

SEQ ID NO: 290 - protein, 10 aa, Artificial Sequence
  Description of Artificial Sequence: Synthetic peptide
QQYGSSPPYT

SEQ ID NO: 291 - protein, 6 aa, Artificial Sequence
  Description of Artificial Sequence: Synthetic peptide
SNYDMN

SEQ ID NO: 292 - protein, 13 aa, Artificial Sequence
  Description of Artificial Sequence: Synthetic peptide
WVSSISSSSSYIY

SEQ ID NO: 293 - protein, 16 aa, Artificial Sequence
  Description of Artificial Sequence: Synthetic peptide
ARDVGVTTDYYYYGMD

SEQ ID NO: 294 - protein, 8 aa, Artificial Sequence
  Description of Artificial Sequence: Synthetic peptide
ASSYLAWY

SEQ ID NO: 295 - protein, 10 aa, Artificial Sequence
  Description of Artificial Sequence: Synthetic peptide
LLIYGASSRA

SEQ ID NO: 296 - protein, 9 aa, Artificial Sequence
  Description of Artificial Sequence: Synthetic peptide
QQYGSSPPY

SEQ ID NO: 297 - protein, 8 aa, Artificial Sequence
  Description of Artificial Sequence: Synthetic peptide
GFTFSNYD

SEQ ID NO: 298 - protein, 8 aa, Artificial Sequence
  Description of Artificial Sequence: Synthetic peptide
ISSSSSYI

SEQ ID NO: 299 - protein, 17 aa, Artificial Sequence
  Description of Artificial Sequence: Synthetic peptide
ARDVGVTTDYYYYGMDV

SEQ ID NO: 300 - protein, 7 aa, Artificial Sequence
  Description of Artificial Sequence: Synthetic peptide
QSVASSY

SEQ ID NO: 301 - protein, 3 aa, Artificial Sequence
  Description of Artificial Sequence: Synthetic peptide
GAS

SEQ ID NO: 302 - protein, 10 aa, Artificial Sequence
  Description of Artificial Sequence: Synthetic peptide
QQYGSSPPYT

SEQ ID NO: 303 - protein, 124 aa, Artificial Sequence
  Description of Artificial Sequence: Synthetic polypeptide
EVQLVQSGGGLVKPGGSLRLSCSASGFTFSNYDMNWVRQAPGKGLEWVSSISSSSSYIYYADSVKGRFTISRDNAKNSLYLQMNSLRAEDTAVYHCARDVGVTTDYYYYGMDVWGQGTMVTVSS

SEQ ID NO: 304 - protein, 109 aa, Artificial Sequence
  Description of Artificial Sequence: Synthetic polypeptide
ETTLTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTKVEIK

SEQ ID NO: 305 - protein, 454 aa, Artificial Sequence
  Description of Artificial Sequence: Synthetic polypeptide
EVQLVQSGGGLVKPGGSLRLSCSASGFTFSNYDMNWVRQAPGKGLEWVSSISSSSSYIYYADSVKGRFTISRDNAKNSLYLQMNSLRAEDTAVYHCARDVGVTTDYYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 306 - protein, 216 aa, Artificial Sequence
  Description of Artificial Sequence: Synthetic polypeptide
ETTLTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 307 - protein, 5 aa, Artificial Sequence
  Description of Artificial Sequence: Synthetic peptide
INSMN

SEQ ID NO: 308 - protein, 17 aa, Artificial Sequence
  Description of Artificial Sequence: Synthetic peptide
SISSTSDYIFNADSVKG

SEQ ID NO: 309 - protein, 9 aa, Artificial Sequence
  Description of Artificial Sequence: Synthetic peptide
DDVFGAFDI

SEQ ID NO: 310 - protein, 12 aa, Artificial Sequence
  Description of Artificial Sequence: Synthetic peptide
RTSQSVSRSYLG

SEQ ID NO: 311 - protein, 7 aa, Artificial Sequence
  Description of Artificial Sequence: Synthetic peptide
GSSSRAT

SEQ ID NO: 312 - protein, 9 aa, Artificial Sequence
  Description of Artificial Sequence: Synthetic peptide
QQYSRSPLT

SEQ ID NO: 313 - protein, 7 aa, Artificial Sequence
  Description of Artificial Sequence: Synthetic peptide
GFTFSIN

SEQ ID NO: 314 - protein, 6 aa, Artificial Sequence
  Description of Artificial Sequence: Synthetic peptide
SSTSDY

SEQ ID NO: 315 - protein, 8 aa, Artificial Sequence
  Description of Artificial Sequence: Synthetic peptide
DDVFGAFD

SEQ ID NO: 316 - protein, 8 aa, Artificial Sequence
  Description of Artificial Sequence: Synthetic peptide
SQSVSRSY

SEQ ID NO: 317 - protein, 3 aa, Artificial Sequence
  Description of Artificial Sequence: Synthetic peptide
GSS

SEQ ID NO: 318 - protein, 6 aa, Artificial Sequence
  Description of Artificial Sequence: Synthetic peptide
YSRSPL

SEQ ID NO: 319 - protein, 10 aa, Artificial Sequence
  Description of Artificial Sequence: Synthetic peptide
GFTFSINSMN

SEQ ID NO: 320 - protein, 10 aa, Artificial Sequence
  Description of Artificial Sequence: Synthetic peptide
SISSTSDYIF

SEQ ID NO: 321 - protein, 9 aa, Artificial Sequence
  Description of Artificial Sequence: Synthetic peptide
DDVFGAFDI

SEQ ID NO: 322 - protein, 12 aa, Artificial Sequence
  Description of Artificial Sequence: Synthetic peptide
RTSQSVSRSYLG

SEQ ID NO: 323 - protein, 7 aa, Artificial Sequence
  Description of Artificial Sequence: Synthetic peptide
GSSSRAT

SEQ ID NO: 324 - protein, 9 aa, Artificial Sequence
  Description of Artificial Sequence: Synthetic peptide
QQYSRSPLT

SEQ ID NO: 325 - protein, 6 aa, Artificial Sequence
  Description of Artificial Sequence: Synthetic peptide
SINSMN

SEQ ID NO: 326 - protein, 13 aa, Artificial Sequence
  Description of Artificial Sequence: Synthetic peptide
WVSSISSTSDYIF

SEQ ID NO: 327 - protein, 10 aa, Artificial Sequence
  Description of Artificial Sequence: Synthetic peptide
VRDDVFGAFD

SEQ ID NO: 328 - protein, 8 aa, Artificial Sequence
  Description of Artificial Sequence: Synthetic peptide
SRSYLGWY

SEQ ID NO: 329 - protein, 10 aa, Artificial Sequence
  Description of Artificial Sequence: Synthetic peptide
LLIFGSSSRA

SEQ ID NO: 330 - protein, 8 aa, Artificial Sequence
  Description of Artificial Sequence: Synthetic peptide
QQYSRSPL

SEQ ID NO: 331 - protein, 8 aa, Artificial Sequence
  Description of Artificial Sequence: Synthetic peptide
GFTFSINS

SEQ ID NO: 332 - protein, 8 aa, Artificial Sequence
  Description of Artificial Sequence: Synthetic peptide
ISSTSDYI

SEQ ID NO: 333 - protein, 11 aa, Artificial Sequence
  Description of Artificial Sequence: Synthetic peptide
VRDDVFGAFDI

SEQ ID NO: 334 - protein, 7 aa, Artificial Sequence
  Description of Artificial Sequence: Synthetic peptide
QSVSRSY

SEQ ID NO: 335 - protein, 3 aa, Artificial Sequence
  Description of Artificial Sequence: Synthetic peptide
GSS

SEQ ID NO: 336 - protein, 9 aa, Artificial Sequence
  Description of Artificial Sequence: Synthetic peptide
QQYSRSPLT

SEQ ID NO: 337 - protein, 118 aa, Artificial Sequence
  Description of Artificial Sequence: Synthetic polypeptide
EVQLVESGGGLVKPGGSLRLSCEASGFTFSINSMNWVRQAPGKGLEWVSSISSTSDYIFNADSVKGRFTISRDNAKNSLYLQMNSLRAEDTAVYYCVRDDVFGAFDIWGQGTMVTVSS

SEQ ID NO: 338 - protein, 108 aa, Artificial Sequence
  Description of Artificial Sequence: Synthetic polypeptide
EIVLTQSPGTLSLSPGERATLSCRTSQSVSRSYLGWYQQKPGQPPRLLIFGSSSRATGIPDRFSGSGSGTDFTLTISRLEPEDFAVYYCQQYSRSPLTFGGGTKVDIK

SEQ ID NO: 339 - protein, 448 aa, Artificial Sequence
  Description of Artificial Sequence: Synthetic polypeptide
EVQLVESGGGLVKPGGSLRLSCEASGFTFSINSMNWVRQAPGKGLEWVSSISSTSDYIFNADSVKGRFTISRDNAKNSLYLQMNSLRAEDTAVYYCVRDDVFGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 340 - protein, 215 aa, Artificial Sequence
  Description of Artificial Sequence: Synthetic polypeptide
EIVLTQSPGTLSLSPGERATLSCRTSQSVSRSYLGWYQQKPGQPPRLLIFGSSSRATGIPDRFSGSGSGTDFTLTISRLEPEDFAVYYCQQYSRSPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 341 - protein, 5 aa, Artificial Sequence
  Description of Artificial Sequence: Synthetic peptide
NYDMN

SEQ ID NO: 342 - protein, 17 aa, Artificial Sequence
  Description of Artificial Sequence: Synthetic peptide
SISSSSSYIYYADSVKG

SEQ ID NO: 343 - protein, 15 aa, Artificial Sequence
  Description of Artificial Sequence: Synthetic peptide
DVGVTTDYYYYGMDV

SEQ ID NO: 344 - protein, 12 aa, Artificial Sequence
  Description of Artificial Sequence: Synthetic peptide
RASQSVASSYLA

SEQ ID NO: 345 - protein, 7 aa, Artificial Sequence
  Description of Artificial Sequence: Synthetic peptide
GASSRAT

SEQ ID NO: 346 - protein, 10 aa, Artificial Sequence
  Description of Artificial Sequence: Synthetic peptide
QQYGSSPPYT

SEQ ID NO: 347 - protein, 7 aa, Artificial Sequence
  Description of Artificial Sequence: Synthetic peptide
GFTFSNY

SEQ ID NO: 348 - protein, 6 aa, Artificial Sequence
  Description of Artificial Sequence: Synthetic peptide
SSSSSY

SEQ ID NO: 349 - protein, 14 aa, Artificial Sequence
  Description of Artificial Sequence: Synthetic peptide
DVGVTTDYYYYGMD

SEQ ID NO: 350 - protein, 8 aa, Artificial Sequence
  Description of Artificial Sequence: Synthetic peptide
SQSVASSY

SEQ ID NO: 351 - protein, 3 aa, Artificial Sequence
  Description of Artificial Sequence: Synthetic peptide
GAS

SEQ ID NO: 352 - protein, 7 aa, Artificial Sequence
  Description of Artificial Sequence: Synthetic peptide
YGSSPPY

SEQ ID NO: 353 - protein, 10 aa, Artificial Sequence
  Description of Artificial Sequence: Synthetic peptide
GFTFSNYDMN

SEQ ID NO: 354 - protein, 10 aa, Artificial Sequence
  Description of Artificial Sequence: Synthetic peptide
SISSSSSYIY

SEQ ID NO: 355 - protein, 15 aa, Artificial Sequence
  Description of Artificial Sequence: Synthetic peptide
DVGVTTDYYYYGMDV

SEQ ID NO: 356 - protein, 12 aa, Artificial Sequence
  Description of Artificial Sequence: Synthetic peptide
RASQSVASSYLA

SEQ ID NO: 357 - protein, 7 aa, Artificial Sequence
  Description of Artificial Sequence: Synthetic peptide
GASSRAT

SEQ ID NO: 358 - protein, 10 aa, Artificial Sequence
  Description of Artificial Sequence: Synthetic peptide
QQYGSSPPYT

SEQ ID NO: 359 - protein, 6 aa, Artificial Sequence
  Description of Artificial Sequence: Synthetic peptide
SNYDMN

SEQ ID NO: 360 - protein, 13 aa, Artificial Sequence
  Description of Artificial Sequence: Synthetic peptide
WVSSISSSSSYIY

SEQ ID NO: 361 - protein, 16 aa, Artificial Sequence
  Description of Artificial Sequence: Synthetic peptide
ARDVGVTTDYYYYGMD

SEQ ID NO: 362 - protein, 8 aa, Artificial Sequence
  Description of Artificial Sequence: Synthetic peptide
ASSYLAWY

SEQ ID NO: 363 - protein, 10 aa, Artificial Sequence
  Description of Artificial Sequence: Synthetic peptide
LLIYGASSRA

SEQ ID NO: 364 - protein, 9 aa, Artificial Sequence
  Description of Artificial Sequence: Synthetic peptide
QQYGSSPPY

SEQ ID NO: 365 - protein, 8 aa, Artificial Sequence
  Description of Artificial Sequence: Synthetic peptide
GFTFSNYD

SEQ ID NO: 366 - protein, 8 aa, Artificial Sequence
  Description of Artificial Sequence: Synthetic peptide
ISSSSSYI

SEQ ID NO: 367 - protein, 17 aa, Artificial Sequence
  Description of Artificial Sequence: Synthetic peptide
ARDVGVTTDYYYYGMDV

SEQ ID NO: 368 - protein, 7 aa, Artificial Sequence
  Description of Artificial Sequence: Synthetic peptide
QSVASSY

SEQ ID NO: 369 - protein, 3 aa, Artificial Sequence
  Description of Artificial Sequence: Synthetic peptide
GAS

SEQ ID NO: 370 - protein, 10 aa, Artificial Sequence
  Description of Artificial Sequence: Synthetic peptide
QQYGSSPPYT

SEQ ID NO: 371 - protein, 124 aa, Artificial Sequence
  Description of Artificial Sequence: Synthetic polypeptide
EVQLVESGGGLVKPGGSLRLSCSASGFTFSNYDMNWVRQAPGKGLEWVSSISSSSSYIYYADSVKGRFTISRDNAKNSLYLQMNSLRAEDTAVYHCARDVGVTTDYYYYGMDVWGQGTTVTVSS

SEQ ID NO: 372 - protein, 109 aa, Artificial Sequence
  Description of Artificial Sequence: Synthetic polypeptide
EIVLTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTKLEIK

SEQ ID NO: 373 - protein, 454 aa, Artificial Sequence
  Description of Artificial Sequence: Synthetic polypeptide
EVQLVESGGGLVKPGGSLRLSCSASGFTFSNYDMNWVRQAPGKGLEWVSSISSSSSYIYYADSVKGRFTISRDNAKNSLYLQMNSLRAEDTAVYHCARDVGVTTDYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 374 - protein, 216 aa, Artificial Sequence
  Description of Artificial Sequence: Synthetic polypeptide
EIVLTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 375 - protein, 5 aa, Artificial Sequence
  Description of Artificial Sequence: Synthetic peptide
SYDIN

SEQ ID NO: 376 - protein, 17 aa, Artificial Sequence
  Description of Artificial Sequence: Synthetic peptide
SITSSSYYIYYADSVKG

SEQ ID NO: 377 - protein, 16 aa, Artificial Sequence
  Description of Artificial Sequence: Synthetic peptide
DLGVRGVDYYYYGLDV

SEQ ID NO: 378 - protein, 12 aa, Artificial Sequence
  Description of Artificial Sequence: Synthetic peptide
RASQSVSSSYLA

SEQ ID NO: 379 - protein, 7 aa, Artificial Sequence
  Description of Artificial Sequence: Synthetic peptide
GASSRAT

SEQ ID NO: 380 - protein, 10 aa, Artificial Sequence
  Description of Artificial Sequence: Synthetic peptide
QQYGSSPPYT

SEQ ID NO: 381 - protein, 7 aa, Artificial Sequence
  Description of Artificial Sequence: Synthetic peptide
GFTFSSY

SEQ ID NO: 382 - protein, 6 aa, Artificial Sequence
  Description of Artificial Sequence: Synthetic peptide
TSSSYY

SEQ ID NO: 383 - protein, 15 aa, Artificial Sequence
  Description of Artificial Sequence: Synthetic peptide
DLGVRGVDYYYYGLD

SEQ ID NO: 384 - protein, 8 aa, Artificial Sequence
  Description of Artificial Sequence: Synthetic peptide
SQSVSSSY

SEQ ID NO: 385 - protein, 3 aa, Artificial Sequence
  Description of Artificial Sequence: Synthetic peptide
GAS

SEQ ID NO: 386 - protein, 7 aa, Artificial Sequence
  Description of Artificial Sequence: Synthetic peptide
YGSSPPY

SEQ ID NO: 387 - protein, 10 aa, Artificial Sequence
  Description of Artificial Sequence: Synthetic peptide
GFTFSSYDIN

SEQ ID NO: 388 - protein, 10 aa, Artificial Sequence
  Description of Artificial Sequence: Synthetic peptide
SITSSSYYIY

SEQ ID NO: 389 - protein, 16 aa, Artificial Sequence
  Description of Artificial Sequence: Synthetic peptide
DLGVRGVDYYYYGLDV

SEQ ID NO: 390 - protein, 12 aa, Artificial Sequence
  Description of Artificial Sequence: Synthetic peptide
RASQSVSSSYLA

SEQ ID NO: 391 - protein, 7 aa, Artificial Sequence
  Description of Artificial Sequence: Synthetic peptide
GASSRAT

SEQ ID NO: 392 - protein, 10 aa, Artificial Sequence
  Description of Artificial Sequence: Synthetic peptide
QQYGSSPPYT

SEQ ID NO: 393 - protein, 6 aa, Artificial Sequence
  Description of Artificial Sequence: Synthetic peptide
SSYDIN

SEQ ID NO: 394 - protein, 13 aa, Artificial Sequence
  Description of Artificial Sequence: Synthetic peptide
WVSSITSSSYYIY

SEQ ID NO: 395 - protein, 17 aa, Artificial Sequence
  Description of Artificial Sequence: Synthetic peptide
ARDLGVRGVDYYYYGLD

SEQ ID NO: 396 - protein, 8 aa, Artificial Sequence
  Description of Artificial Sequence: Synthetic peptide
SSSYLAWY

SEQ ID NO: 397 - protein, 10 aa, Artificial Sequence
  Description of Artificial Sequence: Synthetic peptide
LLIYGASSRA

SEQ ID NO: 398 - protein, 9 aa, Artificial Sequence
  Description of Artificial Sequence: Synthetic peptide
QQYGSSPPY

SEQ ID NO: 399 - protein, 8 aa, Artificial Sequence
  Description of Artificial Sequence: Synthetic peptide
GFTFSSYD

SEQ ID NO: 400 - protein, 8 aa, Artificial Sequence
  Description of Artificial Sequence: Synthetic peptide
ITSSSYYI

SEQ ID NO: 401 - protein, 18 aa, Artificial Sequence
  Description of Artificial Sequence: Synthetic peptide
ARDLGVRGVDYYYYGLDV

SEQ ID NO: 402 - protein, 7 aa, Artificial Sequence
  Description of Artificial Sequence: Synthetic peptide
QSVSSSY

SEQ ID NO: 403 - protein, 3 aa, Artificial Sequence
  Description of Artificial Sequence: Synthetic peptide
GAS

SEQ ID NO: 404 - protein, 10 aa, Artificial Sequence
  Description of Artificial Sequence: Synthetic peptide
QQYGSSPPYT

SEQ ID NO: 405 - protein, 125 aa, Artificial Sequence
  Description of Artificial Sequence: Synthetic polypeptide
EVQLVESGGGLVKPGGSLRLSCAASGFTFSSYDINWVRQAPGKGLEWVSSITSSSYYIYYADSVKGRFTISRDNAKNSLYLQMNSLRAEDTAVYYCARDLGVRGVDYYYYGLDVWGQGTMVTVSS

SEQ ID NO: 406 - protein, 109 aa, Artificial Sequence
  Description of Artificial Sequence: Synthetic polypeptide
EIVMTQSPGTLSLSPGERATLSCRASQSVSSSYLAWYQQKPGQAPRLLIYGASSRATGIPDRFSGSGSGTDFTLTISRLEPEDFAVYYCQQYGSSPPYTFGQGTKVEIK

SEQ ID NO: 407 - protein, 455 aa, Artificial Sequence
  Description of Artificial Sequence: Synthetic polypeptide
EVQLVESGGGLVKPGGSLRLSCAASGFTFSSYDINWVRQAPGKGLEWVSSITSSSYYIYYADSVKGRFTISRDNAKNSLYLQMNSLRAEDTAVYYCARDLGVRGVDYYYYGLDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 408 - protein, 216 aa, Artificial Sequence
  Description of Artificial Sequence: Synthetic polypeptide
EIVMTQSPGTLSLSPGERATLSCRASQSVSSSYLAWYQQKPGQAPRLLIYGASSRATGIPDRFSGSGSGTDFTLTISRLEPEDFAVYYCQQYGSSPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 409 - protein, 5 aa, Artificial Sequence
  Description of Artificial Sequence: Synthetic peptide
NYDMN

SEQ ID NO: 410 - protein, 17 aa, Artificial Sequence
  Description of Artificial Sequence: Synthetic peptide
SISSSSSYIYYADSVKG

SEQ ID NO: 411 - protein, 15 aa, Artificial Sequence
  Description of Artificial Sequence: Synthetic peptide
DVGVTTDYYYYGMDV

SEQ ID NO: 412 - protein, 12 aa, Artificial Sequence
  Description of Artificial Sequence: Synthetic peptide
RASQSVASSYLA

SEQ ID NO: 413 - protein, 7 aa, Artificial Sequence
  Description of Artificial Sequence: Synthetic peptide
GASSRAT

SEQ ID NO: 414 - protein, 10 aa, Artificial Sequence
  Description of Artificial Sequence: Synthetic peptide
QQYGSSPPYT

SEQ ID NO: 415 - protein, 7 aa, Artificial Sequence
  Description of Artificial Sequence: Synthetic peptide
GFTFSNY

SEQ ID NO: 416 - protein, 6 aa, Artificial Sequence
  Description of Artificial Sequence: Synthetic peptide
SSSSSY

SEQ ID NO: 417 - protein, 14 aa, Artificial Sequence
  Description of Artificial Sequence: Synthetic peptide
DVGVTTDYYYYGMD

SEQ ID NO: 418 - protein, 8 aa, Artificial Sequence
  Description of Artificial Sequence: Synthetic peptide
SQSVASSY

SEQ ID NO: 419 - protein, 3 aa, Artificial Sequence
  Description of Artificial Sequence: Synthetic peptide
GAS

SEQ ID NO: 420 - protein, 7 aa, Artificial Sequence
  Description of Artificial Sequence: Synthetic peptide
YGSSPPY

SEQ ID NO: 421 - protein, 10 aa, Artificial Sequence
  Description of Artificial Sequence: Synthetic peptide
GFTFSNYDMN

SEQ ID NO: 422 - protein, 10 aa, Artificial Sequence
  Description of Artificial Sequence: Synthetic peptide
SISSSSSYIY

SEQ ID NO: 423 - protein, 15 aa, Artificial Sequence
  Description of Artificial Sequence: Synthetic peptide
DVGVTTDYYYYGMDV

SEQ ID NO: 424 - protein, 12 aa, Artificial Sequence
  Description of Artificial Sequence: Synthetic peptide
RASQSVASSYLA

SEQ ID NO: 425 - protein, 7 aa, Artificial Sequence
  Description of Artificial Sequence: Synthetic peptide
GASSRAT

SEQ ID NO: 426 - protein, 10 aa, Artificial Sequence
  Description of Artificial Sequence: Synthetic peptide
QQYGSSPPYT

SEQ ID NO: 427 - protein, 6 aa, Artificial Sequence
  Description of Artificial Sequence: Synthetic peptide
SNYDMN

SEQ ID NO: 428 - protein, 13 aa, Artificial Sequence
  Description of Artificial Sequence: Synthetic peptide
WVSSISSSSSYIY

SEQ ID NO: 429 - protein, 16 aa, Artificial Sequence
  Description of Artificial Sequence: Synthetic peptide
ARDVGVTTDYYYYGMD

SEQ ID NO: 430 - protein, 8 aa, Artificial Sequence
  Description of Artificial Sequence: Synthetic peptide
ASSYLAWY

SEQ ID NO: 431 - protein, 10 aa, Artificial Sequence
  Description of Artificial Sequence: Synthetic peptide
LLIYGASSRA

SEQ ID NO: 432 - protein, 9 aa, Artificial Sequence
  Description of Artificial Sequence: Synthetic peptide
QQYGSSPPY

SEQ ID NO: 433 - protein, 8 aa, Artificial Sequence
  Description of Artificial Sequence: Synthetic peptide
GFTFSNYD

SEQ ID NO: 434 - protein, 8 aa, Artificial Sequence
  Description of Artificial Sequence: Synthetic peptide
ISSSSSYI

SEQ ID NO: 435 - protein, 17 aa, Artificial Sequence
  Description of Artificial Sequence: Synthetic peptide
ARDVGVTTDYYYYGMDV

SEQ ID NO: 436 - protein, 7 aa, Artificial Sequence
  Description of Artificial Sequence: Synthetic peptide
QSVASSY

SEQ ID NO: 437 - protein, 3 aa, Artificial Sequence
  Description of Artificial Sequence: Synthetic peptide
GAS

SEQ ID NO: 438 - protein, 10 aa, Artificial Sequence
  Description of Artificial Sequence: Synthetic peptide
QQYGSSPPYT

SEQ ID NO: 439 - protein, 124 aa, Artificial Sequence; identical to SEQ ID NO: 371
  Description of Artificial Sequence: Synthetic polypeptide

SEQ ID NO: 440 - protein, 109 aa, Artificial Sequence
  Description of Artificial Sequence: Synthetic polypeptide
ETTLTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTKLEIK

SEQ ID NO: 441 - protein, 454 aa, Artificial Sequence; identical to SEQ ID NO: 373
  Description of Artificial Sequence: Synthetic polypeptide

SEQ ID NO: 442 - protein, 216 aa, Artificial Sequence
  Description of Artificial Sequence: Synthetic polypeptide
ETTLTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 443 - protein, 5 aa, Artificial Sequence
  Description of Artificial Sequence: Synthetic peptide
VYSMN

SEQ ID NO: 444 - protein, 17 aa, Artificial Sequence
  Description of Artificial Sequence: Synthetic peptide
SIGSSSSYIFYADSVKG

SEQ ID NO: 445 - protein, 9 aa, Artificial Sequence
  Description of Artificial Sequence: Synthetic peptide
DHDYGGLDY

SEQ ID NO: 446 - protein, 12 aa, Artificial Sequence
  Description of Artificial Sequence: Synthetic peptide
RASQSVSSSYLA

SEQ ID NO: 447 - protein, 7 aa, Artificial Sequence
  Description of Artificial Sequence: Synthetic peptide
GPSNRAT

SEQ ID NO: 448 - protein, 9 aa, Artificial Sequence
  Description of Artificial Sequence: Synthetic peptide
QQYGRSPLT

SEQ ID NO: 449 - protein, 7 aa, Artificial Sequence
  Description of Artificial Sequence: Synthetic peptide
GFTFSVY

SEQ ID NO: 450 - protein, 6 aa, Artificial Sequence
  Description of Artificial Sequence: Synthetic peptide
GSSSSY

SEQ ID NO: 451 - protein, 8 aa, Artificial Sequence
  Description of Artificial Sequence: Synthetic peptide
DHDYGGLD

SEQ ID NO: 452 - protein, 8 aa, Artificial Sequence
  Description of Artificial Sequence: Synthetic peptide
SQSVSSSY

SEQ ID NO: 453 - protein, 3 aa, Artificial Sequence
  Description of Artificial Sequence: Synthetic peptide
GPS

SEQ ID NO: 454 - protein, 6 aa, Artificial Sequence
  Description of Artificial Sequence: Synthetic peptide
YGRSPL

SEQ ID NO: 455 - protein, 10 aa, Artificial Sequence
  Description of Artificial Sequence: Synthetic peptide
GFTFSVYSMN

SEQ ID NO: 456 - protein, 10 aa, Artificial Sequence
  Description of Artificial Sequence: Synthetic peptide
SIGSSSSYIF

SEQ ID NO: 457 - protein, 9 aa, Artificial Sequence
  Description of Artificial Sequence: Synthetic peptide
DHDYGGLDY

SEQ ID NO: 458 - protein, 12 aa, Artificial Sequence
  Description of Artificial Sequence: Synthetic peptide
RASQSVSSSYLA

SEQ ID NO: 459 - protein, 7 aa, Artificial Sequence
  Description of Artificial Sequence: Synthetic peptide
GPSNRAT

SEQ ID NO: 460 - protein, 9 aa, Artificial Sequence
  Description of Artificial Sequence: Synthetic peptide
QQYGRSPLT

SEQ ID NO: 461 - protein, 6 aa, Artificial Sequence
  Description of Artificial Sequence: Synthetic peptide
SVYSMN

SEQ ID NO: 462 - protein, 13 aa, Artificial Sequence
  Description of Artificial Sequence: Synthetic peptide
WVSSIGSSSSYIF

SEQ ID NO: 463 - protein, 10 aa, Artificial Sequence
  Description of Artificial Sequence: Synthetic peptide
GRDHDYGGLD

SEQ ID NO: 464 - protein, 8 aa, Artificial Sequence
  Description of Artificial Sequence: Synthetic peptide
SSSYLAWY

SEQ ID NO: 465 - protein, 10 aa, Artificial Sequence
  Description of Artificial Sequence: Synthetic peptide
LLIYGPSNRA

SEQ ID NO: 466 - protein, 8 aa, Artificial Sequence
  Description of Artificial Sequence: Synthetic peptide
QQYGRSPL

SEQ ID NO: 467 - protein, 8 aa, Artificial Sequence
  Description of Artificial Sequence: Synthetic peptide
GFTFSVYS

SEQ ID NO: 468 - protein, 8 aa, Artificial Sequence
  Description of Artificial Sequence: Synthetic peptide
IGSSSSYI

SEQ ID NO: 469 - protein, 11 aa, Artificial Sequence
  Description of Artificial Sequence: Synthetic peptide
GRDHDYGGLDY

SEQ ID NO: 470 - protein, 7 aa, Artificial Sequence
  Description of Artificial Sequence: Synthetic peptide
QSVSSSY

SEQ ID NO: 471 - protein, 3 aa, Artificial Sequence
  Description of Artificial Sequence: Synthetic peptide
GPS

SEQ ID NO: 472 - protein, 9 aa, Artificial Sequence
  Description of Artificial Sequence: Synthetic peptide
QQYGRSPLT

SEQ ID NO: 473 - protein, 118 aa, Artificial Sequence
  Description of Artificial Sequence: Synthetic polypeptide
EVQLVESGGGLVKPGGSLRLSCAASGFTFSVYSMNWVRQAPGKGLEWVSSIGSSSSYIFYADSVKGRFTISRDNAKNSLYLQMNSLRAEDTAVYYCGRDHDYGGLDYWGQGTLVTVSS

SEQ ID NO: 474 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGPSNRATDIPDRFSGTGSGTDFTLTISRLEPEDFAVYYCQQYGRSPLTFGGGTKVEIK

SEQ ID NO: 475 - protein, 448 aa, Artificial Sequence
  Description of Artificial Sequence: Synthetic polypeptide
EVQLVESGGGLVKPGGSLRLSCAASGFTFSVYSMNWVRQAPGKGLEWVSSIGSSSSYIFYADSVKGRFTISRDNAKNSLYLQMNSLRAEDTAVYYCGRDHDYGGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 476 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIYGPSNRATDIPDRFSGTGSGTDFTLTISRLEPEDFAVYYCQQYGRSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 477 - protein, 5 aa, Artificial Sequence
  Description of Artificial Sequence: Synthetic peptide
SIYWS

SEQ ID NO: 478 - protein, 16 aa, Artificial Sequence
  Description of Artificial Sequence: Synthetic peptide
RIYTTDITNYNPSLKS

SEQ ID NO: 479 - protein, 10 aa, Artificial Sequence
  Description of Artificial Sequence: Synthetic peptide
NGYSYGGFNY

SEQ ID NO: 480 - protein, 14 aa, Artificial Sequence
  Description of Artificial Sequence: Synthetic peptide
TGSSSNIGAGYDVH

SEQ ID NO: 481 - protein, 7 aa, Artificial Sequence
  Description of Artificial Sequence: Synthetic peptide
GDSYRPS

SEQ ID NO: 482 - protein, 11 aa, Artificial Sequence
  Description of Artificial Sequence: Synthetic peptide
QSYDSSLSVVV

SEQ ID NO: 483 - protein, 7 aa, Artificial Sequence
  Description of Artificial Sequence: Synthetic peptide
GDSISSI

SEQ ID NO: 484 - protein, 5 aa, Artificial Sequence
  Description of Artificial Sequence: Synthetic peptide
YTTDI

SEQ ID NO: 485 - protein, 9 aa, Artificial Sequence
  Description of Artificial Sequence: Synthetic peptide
NGYSYGGFN

SEQ ID NO: 486 - protein, 10 aa, Artificial Sequence
  Description of Artificial Sequence: Synthetic peptide
SSSNIGAGYD

SEQ ID NO: 487 - protein, 3 aa, Artificial Sequence
  Description of Artificial Sequence: Synthetic peptide
GDS

SEQ ID NO: 488 - protein, 8 aa, Artificial Sequence
  Description of Artificial Sequence: Synthetic peptide
YDSSLSVV

SEQ ID NO: 489 - protein, 10 aa, Artificial Sequence
  Description of Artificial Sequence: Synthetic peptide
GDSISSIYWS

SEQ ID NO: 490 - protein, 9 aa, Artificial Sequence
  Description of Artificial Sequence: Synthetic peptide
RIYTTDITN

SEQ ID NO: 491 - protein, 10 aa, Artificial Sequence
  Description of Artificial Sequence: Synthetic peptide
NGYSYGGFNY

SEQ ID NO: 492 - protein, 14 aa, Artificial Sequence
  Description of Artificial Sequence: Synthetic peptide
TGSSSNIGAGYDVH

SEQ ID NO: 493 - protein, 7 aa, Artificial Sequence
  Description of Artificial Sequence: Synthetic peptide
GDSYRPS

SEQ ID NO: 494 - protein, 11 aa, Artificial Sequence
  Description of Artificial Sequence: Synthetic peptide
QSYDSSLSVVV

SEQ ID NO: 495 - protein, 6 aa, Artificial Sequence
  Description of Artificial Sequence: Synthetic peptide
SSIYWS

SEQ ID NO: 496 - protein, 12 aa, Artificial Sequence
  Description of Artificial Sequence: Synthetic peptide
WIGRIYTTDITN

SEQ ID NO: 497 - protein, 11 aa, Artificial Sequence
  Description of Artificial Sequence: Synthetic peptide
AKNGYSYGGFN

SEQ ID NO: 498 - protein, 10 aa, Artificial Sequence
  Description of Artificial Sequence: Synthetic peptide
IGAGYDVHWY

SEQ ID NO: 499 - protein, 10 aa, Artificial Sequence
  Description of Artificial Sequence: Synthetic peptide
LLIYGDSYRP

SEQ ID NO: 500 - protein, 10 aa, Artificial Sequence
  Description of Artificial Sequence: Synthetic peptide
QSYDSSLSVV

SEQ ID NO: 501 - protein, 8 aa, Artificial Sequence
  Description of Artificial Sequence: Synthetic peptide
GDSISSIY

SEQ ID NO: 502 - protein, 7 aa, Artificial Sequence
  Description of Artificial Sequence: Synthetic peptide
IYTTDIT

SEQ ID NO: 503 - protein, 12 aa, Artificial Sequence
  Description of Artificial Sequence: Synthetic peptide
AKNGYSYGGFNY

SEQ ID NO: 504 - protein, 9 aa, Artificial Sequence
  Description of Artificial Sequence: Synthetic peptide
SSNIGAGYD

SEQ ID NO: 505 - protein, 3 aa, Artificial Sequence
  Description of Artificial Sequence: Synthetic peptide
GDS

SEQ ID NO: 506 - protein, 11 aa, Artificial Sequence
  Description of Artificial Sequence: Synthetic peptide
QSYDSSLSVVV

SEQ ID NO: 507 - protein, 118 aa, Artificial Sequence
  Description of Artificial Sequence: Synthetic polypeptide
QVQLQESGPGLVKPSETLSLTCTVSGDSISSIYWSWIRQSAGKGLEWIGRIYTTDITNYNPSLKSRVTMSADTSKNQLSLKLTSVTAADTAVYYCAKNGYSYGGFNYWGQGTLVTVSS

SEQ ID NO: 508 - protein, 111 aa, Artificial Sequence
  Description of Artificial Sequence: Synthetic polypeptide
QSVLTQPPSVSGAPGQRVTISCTGSSSNIGAGYDVHWYQRLPGTAPKLLIYGDSYRPSGVPDRFSGSKSGTSASLAITGLQAEDEADYYCQSYDSSLSVVVFGGGTKLTVL

SEQ ID NO: 509 - protein, 448 aa, Artificial Sequence
  Description of Artificial Sequence: Synthetic polypeptide
QVQLQESGPGLVKPSETLSLTCTVSGDSISSIYWSWIRQSAGKGLEWIGRIYTTDITNYNPSLKSRVTMSADTSKNQLSLKLTSVTAADTAVYYCAKNGYSYGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 510 - protein, 217 aa, Artificial Sequence
  Description of Artificial Sequence: Synthetic polypeptide
QSVLTQPPSVSGAPGQRVTISCTGSSSNIGAGYDVHWYQRLPGTAPKLLIYGDSYRPSGVPDRFSGSKSGTSASLAITGLQAEDEADYYCQSYDSSLSVVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 511 - protein, 5 aa, Artificial Sequence
  Description of Artificial Sequence: Synthetic peptide
NYDMN

SEQ ID NO: 512 - protein, 17 aa, Artificial Sequence
  Description of Artificial Sequence: Synthetic peptide
SISSSSSYIYYADSVKG

SEQ ID NO: 513 - protein, 15 aa, Artificial Sequence
  Description of Artificial Sequence: Synthetic peptide
DVGVTTDYYYYGMDV

SEQ ID NO: 514 - protein, 13 aa, Artificial Sequence
  Description of Artificial Sequence: Synthetic peptide
SGSSSNIGSNTVN

SEQ ID NO: 515 - protein, 7 aa, Artificial Sequence
  Description of Artificial Sequence: Synthetic peptide
TNTQRPS

SEQ ID NO: 516 - protein, 11 aa, Artificial Sequence
  Description of Artificial Sequence: Synthetic peptide
AAWDDSLNAWV

SEQ ID NO: 517 - protein, 7 aa, Artificial Sequence
  Description of Artificial Sequence: Synthetic peptide
GFTFSNY

SEQ ID NO: 518 - protein, 6 aa, Artificial Sequence
  Description of Artificial Sequence: Synthetic peptide
SSSSSY

SEQ ID NO: 519 - protein, 14 aa, Artificial Sequence
  Description of Artificial Sequence: Synthetic peptide
DVGVTTDYYYYGMD

SEQ ID NO: 520 - protein, 9 aa, Artificial Sequence
  Description of Artificial Sequence: Synthetic peptide
SSSNIGSNT

SEQ ID NO: 521 - protein, 3 aa, Artificial Sequence
  Description of Artificial Sequence: Synthetic peptide
TNT

SEQ ID NO: 522 - protein, 8 aa, Artificial Sequence
  Description of Artificial Sequence: Synthetic peptide
WDDSLNAW

SEQ ID NO: 523 - protein, 10 aa, Artificial Sequence
  Description of Artificial Sequence: Synthetic peptide
GFTFSNYDMN

SEQ ID NO: 524 - protein, 10 aa, Artificial Sequence
  Description of Artificial Sequence: Synthetic peptide
SISSSSSYIY

SEQ ID NO: 525 - protein, 15 aa, Artificial Sequence
  Description of Artificial Sequence: Synthetic peptide
DVGVTTDYYYYGMDV

SEQ ID NO: 526 - protein, 13 aa, Artificial Sequence
  Description of Artificial Sequence: Synthetic peptide
SGSSSNIGSNTVN

SEQ ID NO: 527 - protein, 7 aa, Artificial Sequence
  Description of Artificial Sequence: Synthetic peptide
TNTQRPS

SEQ ID NO: 528 - protein, 11 aa, Artificial Sequence
  Description of Artificial Sequence: Synthetic peptide
AAWDDSLNAWV

SEQ ID NO: 529 - protein, 6 aa, Artificial Sequence
  Description of Artificial Sequence: Synthetic peptide
SNYDMN

SEQ ID NO: 530 - protein, 13 aa, Artificial Sequence
  Description of Artificial Sequence: Synthetic peptide
WVSSISSSSSYIY

SEQ ID NO: 531 - protein, 16 aa, Artificial Sequence
  Description of Artificial Sequence: Synthetic peptide
ARDVGVTTDYYYYGMD

SEQ ID NO: 532 - protein, 9 aa, Artificial Sequence
  Description of Artificial Sequence: Synthetic peptide
IGSNTVNWY

SEQ ID NO: 533 - protein, 10 aa, Artificial Sequence
  Description of Artificial Sequence: Synthetic peptide
LLIYTNTQRP

SEQ ID NO: 534 - protein, 10 aa, Artificial Sequence
  Description of Artificial Sequence: Synthetic peptide
AAWDDSLNAW

SEQ ID NO: 535 - protein, 8 aa, Artificial Sequence
  Description of Artificial Sequence: Synthetic peptide
GFTFSNYD

SEQ ID NO: 536 - protein, 8 aa, Artificial Sequence
  Description of Artificial Sequence: Synthetic peptide
ISSSSSYI

SEQ ID NO: 537 - protein, 17 aa, Artificial Sequence
  Description of Artificial Sequence: Synthetic peptide
ARDVGVTTDYYYYGMDV

SEQ ID NO: 538 - protein, 8 aa, Artificial Sequence
  Description of Artificial Sequence: Synthetic peptide
SSNIGSNT

SEQ ID NO: 539 - protein, 3 aa, Artificial Sequence
  Description of Artificial Sequence: Synthetic peptide
TNT

SEQ ID NO: 540 - protein, 11 aa, Artificial Sequence
  Description of Artificial Sequence: Synthetic peptide
AAWDDSLNAWV

SEQ ID NO: 541 - protein, 124 aa, Artificial Sequence; identical to SEQ ID NO: 371
  Description of Artificial Sequence: Synthetic polypeptide

SEQ ID NO: 542 - protein, 110 aa, Artificial Sequence
  Description of Artificial Sequence: Synthetic polypeptide
QPVLTQSSSASGTPGQRVTISCSGSSSNIGSNTVNWYQQFPGTAPKLLIYTNTQRPSGVPDRFSGSKSGTLVSLAISGLQSEDEADYYCAAWDDSLNAWVFGGGTKLTVL

SEQ ID NO: 543 - protein, 454 aa, Artificial Sequence; identical to SEQ ID NO: 373
  Description of Artificial Sequence: Synthetic polypeptide

SEQ ID NO: 544 - protein, 216 aa, Artificial Sequence
  Description of Artificial Sequence: Synthetic polypeptide
QPVLTQSSSASGTPGQRVTISCSGSSSNIGSNTVNWYQQFPGTAPKLLIYTNTQRPSGVPDRFSGSKSGTLVSLAISGLQSEDEADYYCAAWDDSLNAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 545 - protein, 5 aa, Artificial Sequence
  Description of Artificial Sequence: Synthetic peptide
HYDMN

SEQ ID NO: 546 - protein, 17 aa, Artificial Sequence
  Description of Artificial Sequence: Synthetic peptide
SISSSSSYIFYADSVKG

SEQ ID NO: 547 - protein, 17 aa, Artificial Sequence
  Description of Artificial Sequence: Synthetic peptide
DRGVGDTSDYYSFGLDV

SEQ ID NO: 548 - protein, 12 aa, Artificial Sequence
  Description of Artificial Sequence: Synthetic peptide
RASQNVSSTYLA

SEQ ID NO: 549 - protein, 7 aa, Artificial Sequence
  Description of Artificial Sequence: Synthetic peptide
GACSRAT

SEQ ID NO: 550 - protein, 10 aa, Artificial Sequence
  Description of Artificial Sequence: Synthetic peptide
QQYGSSPPYT

SEQ ID NO: 551 - protein, 7 aa, Artificial Sequence
  Description of Artificial Sequence: Synthetic peptide
GFTFSHY

SEQ ID NO: 552 - protein, 6 aa, Artificial Sequence
  Description of Artificial Sequence: Synthetic peptide
SSSSSY

SEQ ID NO: 553 - protein, 16 aa, Artificial Sequence
  Description of Artificial Sequence: Synthetic peptide
DRGVGDTSDYYSFGLD

SEQ ID NO: 554 - protein, 8 aa, Artificial Sequence
  Description of Artificial Sequence: Synthetic peptide
SQNVSSTY

SEQ ID NO: 555 - protein, 3 aa, Artificial Sequence
  Description of Artificial Sequence: Synthetic peptide
GAC

SEQ ID NO: 556 - protein, 7 aa, Artificial Sequence
  Description of Artificial Sequence: Synthetic peptide
YGSSPPY

SEQ ID NO: 557 - protein, 10 aa, Artificial Sequence
  Description of Artificial Sequence: Synthetic peptide
GFTFSHYDMN

SEQ ID NO: 558 - protein, 10 aa, Artificial Sequence
  Description of Artificial Sequence: Synthetic peptide
SISSSSSYIF

SEQ ID NO: 559 - protein, 17 aa, Artificial Sequence
  Description of Artificial Sequence: Synthetic peptide
DRGVGDTSDYYSFGLDV

SEQ ID NO: 560 - protein, 12 aa, Artificial Sequence
  Description of Artificial Sequence: Synthetic peptide
RASQNVSSTYLA

SEQ ID NO: 561 - protein, 7 aa, Artificial Sequence
  Description of Artificial Sequence: Synthetic peptide
GACSRAT

SEQ ID NO: 562 - protein, 10 aa, Artificial Sequence
  Description of Artificial Sequence: Synthetic peptide
QQYGSSPPYT

SEQ ID NO: 563 - protein, 6 aa, Artificial Sequence
  Description of Artificial Sequence: Synthetic peptide
SHYDMN

SEQ ID NO: 564 - protein, 13 aa, Artificial Sequence
  Description of Artificial Sequence: Synthetic peptide
WVSSISSSSSYIF

SEQ ID NO: 565 - protein, 18 aa, Artificial Sequence
  Description of Artificial Sequence: Synthetic peptide
ARDRGVGDTSDYYSFGLD

SEQ ID NO: 566 - protein, 8 aa, Artificial Sequence
  Description of Artificial Sequence: Synthetic peptide
SSTYLAWY

SEQ ID NO: 567 - protein, 10 aa, Artificial Sequence
  Description of Artificial Sequence: Synthetic peptide
LLIYGACSRA

SEQ ID NO: 568 - protein, 9 aa, Artificial Sequence
  Description of Artificial Sequence: Synthetic peptide
QQYGSSPPY

SEQ ID NO: 569 - protein, 8 aa, Artificial Sequence
  Description of Artificial Sequence: Synthetic peptide
GFTFSHYD

SEQ ID NO: 570 - protein, 8 aa, Artificial Sequence
  Description of Artificial Sequence: Synthetic peptide
ISSSSSYI

SEQ ID NO: 571 - protein, 19 aa, Artificial Sequence
  Description of Artificial Sequence: Synthetic peptide
ARDRGVGDTSDYYSFGLDV

SEQ ID NO: 572 - protein, 7 aa, Artificial Sequence
  Description of Artificial Sequence: Synthetic peptide
QNVSSTY

SEQ ID NO: 573 - protein, 3 aa, Artificial Sequence
  Description of Artificial Sequence: Synthetic peptide
GAC

SEQ ID NO: 574 - protein, 10 aa, Artificial Sequence
  Description of Artificial Sequence: Synthetic peptide
QQYGSSPPYT

SEQ ID NO: 575 - protein, 126 aa, Artificial Sequence
  Description of Artificial Sequence: Synthetic polypeptide
EVQLVESGGGLVKPGGSLRLSCAASGFTFSHYDMNWVRQAPGKGLEWVSSISSSSSYIFYADSVKGRFTISRDNAKNSLLLQMNSLRAEDTAVYHCARDRGVGDTSDYYSFGLDVWGQGTMVTVSS

SEQ ID NO: 576 - protein, 109 aa, Artificial Sequence
  Description of Artificial Sequence: Synthetic polypeptide
DIVMTQSPGTLSLSPGERATLSCRASQNVSSTYLAWYQQKPGQAPRLLIYGACSRATGIPDRFSGSGSGTDFTLTISRLEPEDYAVYYCQQYGSSPPYTFGRGTKLEIK

SEQ ID NO: 577 - protein, 456 aa, Artificial Sequence
  Description of Artificial Sequence: Synthetic polypeptide
EVQLVESGGGLVKPGGSLRLSCAASGFTFSHYDMNWVRQAPGKGLEWVSSISSSSSYIFYADSVKGRFTISRDNAKNSLLLQMNSLRAEDTAVYHCARDRGVGDTSDYYSFGLDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 578 - protein, 216 aa, Artificial Sequence
  Description of Artificial Sequence: Synthetic polypeptide
DIVMTQSPGTLSLSPGERATLSCRASQNVSSTYLAWYQQKPGQAPRLLIYGACSRATGIPDRFSGSGSGTDFTLTISRLEPEDYAVYYCQQYGSSPPYTFGRGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 579 - protein, 5 aa, Artificial Sequence
  Description of Artificial Sequence: Synthetic peptide
NYGMN

SEQ ID NO: 580 - protein, 17 aa, Artificial Sequence
  Description of Artificial Sequence: Synthetic peptide
YISSGSSYKYYADSMKG

SEQ ID NO: 581 - protein, 14 aa, Artificial Sequence
  Description of Artificial Sequence: Synthetic peptide
DPVVTEYYYYGMDV

SEQ ID NO: 582 - protein, 11 aa, Artificial Sequence
  Description of Artificial Sequence: Synthetic peptide
RASQGINSWLA

SEQ ID NO: 583 - protein, 7 aa, Artificial Sequence
  Description of Artificial Sequence: Synthetic peptide
AASSLQS

SEQ ID NO: 584 - protein, 9 aa, Artificial Sequence
  Description of Artificial Sequence: Synthetic peptide
QQANSFPWT

SEQ ID NO: 585 - protein, 7 aa, Artificial Sequence
  Description of Artificial Sequence: Synthetic peptide
GFTFSNY

SEQ ID NO: 586 - protein, 6 aa, Artificial Sequence
  Description of Artificial Sequence: Synthetic peptide
SSGSSY

SEQ ID NO: 587 - protein, 13 aa, Artificial Sequence
  Description of Artificial Sequence: Synthetic peptide
DPVVTEYYYYGMD

SEQ ID NO: 588 - protein, 7 aa, Artificial Sequence
  Description of Artificial Sequence: Synthetic peptide
SQGINSW

SEQ ID NO: 589 - protein, 3 aa, Artificial Sequence
  Description of Artificial Sequence: Synthetic peptide
AAS

SEQ ID NO: 590 - protein, 6 aa, Artificial Sequence
  Description of Artificial Sequence: Synthetic peptide
ANSFPW

SEQ ID NO: 591 - protein, 10 aa, Artificial Sequence
  Description of Artificial Sequence: Synthetic peptide
GFTFSNYGMN

SEQ ID NO: 592 - protein, 10 aa, Artificial Sequence
  Description of Artificial Sequence: Synthetic peptide
YISSGSSYKY

SEQ ID NO: 593 - protein, 14 aa, Artificial Sequence
  Description of Artificial Sequence: Synthetic peptide
DPVVTEYYYYGMDV

SEQ ID NO: 594 - protein, 11 aa, Artificial Sequence
  Description of Artificial Sequence: Synthetic peptide
RASQGINSWLA

SEQ ID NO: 595 - protein, 7 aa, Artificial Sequence
  Description of Artificial Sequence: Synthetic peptide
AASSLQS

SEQ ID NO: 596 - protein, 9 aa, Artificial Sequence
  Description of Artificial Sequence: Synthetic peptide
QQANSFPWT

SEQ ID NO: 597 - protein, 6 aa, Artificial Sequence
  Description of Artificial Sequence: Synthetic peptide
SNYGMN

SEQ ID NO: 598 - protein, 13 aa, Artificial Sequence
  Description of Artificial Sequence: Synthetic peptide
WVSYISSGSSYKY

SEQ ID NO: 599 - protein, 15 aa, Artificial Sequence
  Description of Artificial Sequence: Synthetic peptide
ARDPVVTEYYYYGMD

SEQ ID NO: 600 - protein, 7 aa, Artificial Sequence
  Description of Artificial Sequence: Synthetic peptide
NSWLAWY

SEQ ID NO: 601 - protein, 10 aa, Artificial Sequence
  Description of Artificial Sequence: Synthetic peptide
LLIYAASSLQ

SEQ ID NO: 602 - protein, 8 aa, Artificial Sequence
  Description of Artificial Sequence: Synthetic peptide
QQANSFPW

SEQ ID NO: 603 - protein, 8 aa, Artificial Sequence
  Description of Artificial Sequence: Synthetic peptide
GFTFSNYG

SEQ ID NO: 604 - protein, 8 aa, Artificial Sequence
  Description of Artificial Sequence: Synthetic peptide
ISSGSSYK

SEQ ID NO: 605 - protein, 16 aa, Artificial Sequence
  Description of Artificial Sequence: Synthetic peptide
ARDPVVTEYYYYGMDV

SEQ ID NO: 606 - protein, 6 aa, Artificial Sequence
  Description of Artificial Sequence: Synthetic peptide
QGINSW

SEQ ID NO: 607 - protein, 3 aa, Artificial Sequence
  Description of Artificial Sequence: Synthetic peptide
AAS

SEQ ID NO: 608 - protein, 9 aa, Artificial Sequence
  Description of Artificial Sequence: Synthetic peptide
QQANSFPWT

SEQ ID NO: 609 - protein, 123 aa, Artificial Sequence
  Description of Artificial Sequence: Synthetic polypeptide
EVQLVESGGGLVKPGGSLRLSCAASGFTFSNYGMNWVRQAPGKGLEWVSYISSGSSYKYYADSMKGRFTISRDNAMNLLYLQMNSLRPEDSAMYYCARDPVVTEYYYYGMDVWGQGTMVTVSS

SEQ ID NO: 610 - protein, 107 aa, Artificial Sequence
  Description of Artificial Sequence: Synthetic polypeptide
EIVMTQSPSSVSASVGDRVTITCRASQGINSWLAWYQQKPGNAPKLLIYAASSLQSGVPSRFSGIGSGTDFIFTISSLQPEDFASYYCQQANSFPWTFGQGTKVEIK

SEQ ID NO: 611 - protein, 453 aa, Artificial Sequence
  Description of Artificial Sequence: Synthetic polypeptide
EVQLVESGGGLVKPGGSLRLSCAASGFTFSNYGMNWVRQAPGKGLEWVSYISSGSSYKYYADSMKGRFTISRDNAMNLLYLQMNSLRPEDSAMYYCARDPVVTEYYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 612 - protein, 214 aa, Artificial Sequence
  Description of Artificial Sequence: Synthetic polypeptide
EIVMTQSPSSVSASVGDRVTITCRASQGINSWLAWYQQKPGNAPKLLIYAASSLQSGVPSRFSGIGSGTDFIFTISSLQPEDFASYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 613 - protein, 5 aa, Artificial Sequence
  Description of Artificial Sequence: Synthetic peptide
SYDMN

SEQ ID NO: 614 - protein, 17 aa, Artificial Sequence
  Description of Artificial Sequence: Synthetic peptide
SISSSSSYIYYADSVKG

SEQ ID NO: 615 - protein, 15 aa, Artificial Sequence
  Description of Artificial Sequence: Synthetic peptide
DVGVTTDYYYYGMDV

SEQ ID NO: 616 - protein, 12 aa, Artificial Sequence
  Description of Artificial Sequence: Synthetic peptide
RASQSVASSYLA

SEQ ID NO: 617 - protein, 7 aa, Artificial Sequence
  Description of Artificial Sequence: Synthetic peptide
GASSRAT

SEQ ID NO: 618 - protein, 10 aa, Artificial Sequence
  Description of Artificial Sequence: Synthetic peptide
QQYGSSPPYT

SEQ ID NO: 619 - protein, 7 aa, Artificial Sequence
  Description of Artificial Sequence: Synthetic peptide
GFTFSSY

SEQ ID NO: 620 - protein, 6 aa, Artificial Sequence
  Description of Artificial Sequence: Synthetic peptide
SSSSSY

SEQ ID NO: 621 - protein, 14 aa, Artificial Sequence
  Description of Artificial Sequence: Synthetic peptide
DVGVTTDYYYYGMD

SEQ ID NO: 622 - protein, 8 aa, Artificial Sequence
  Description of Artificial Sequence: Synthetic peptide
SQSVASSY

SEQ ID NO: 623 - protein, 3 aa, Artificial Sequence
  Description of Artificial Sequence: Synthetic peptide
GAS

SEQ ID NO: 624 - protein, 7 aa, Artificial Sequence
  Description of Artificial Sequence: Synthetic peptide
YGSSPPY

SEQ ID NO: 625 - protein, 10 aa, Artificial Sequence
  Description of Artificial Sequence: Synthetic peptide
GFTFSSYDMN

SEQ ID NO: 626 - protein, 10 aa, Artificial Sequence
  Description of Artificial Sequence: Synthetic peptide
SISSSSSYIY

SEQ ID NO: 627 - protein, 15 aa, Artificial Sequence
  Description of Artificial Sequence: Synthetic peptide
DVGVTTDYYYYGMDV

SEQ ID NO: 628 - protein, 12 aa, Artificial Sequence
  Description of Artificial Sequence: Synthetic peptide
RASQSVASSYLA

SEQ ID NO: 629 - protein, 7 aa, Artificial Sequence
  Description of Artificial Sequence: Synthetic peptide
GASSRAT

SEQ ID NO: 630 - protein, 10 aa, Artificial Sequence
  Description of Artificial Sequence: Synthetic peptide
QQYGSSPPYT

SEQ ID NO: 631 - protein, 6 aa, Artificial Sequence
  Description of Artificial Sequence: Synthetic peptide
SSYDMN

SEQ ID NO: 632 - protein, 13 aa, Artificial Sequence
  Description of Artificial Sequence: Synthetic peptide
WVSSISSSSSYIY

SEQ ID NO: 633 - protein, 16 aa, Artificial Sequence
  Description of Artificial Sequence: Synthetic peptide
ARDVGVTTDYYYYGMD

SEQ ID NO: 634 - protein, 8 aa, Artificial Sequence
  Description of Artificial Sequence: Synthetic peptide
ASSYLAWY

SEQ ID NO: 635 - protein, 10 aa, Artificial Sequence
  Description of Artificial Sequence: Synthetic peptide
LLIYGASSRA

SEQ ID NO: 636 - protein, 9 aa, Artificial Sequence
  Description of Artificial Sequence: Synthetic peptide
QQYGSSPPY

SEQ ID NO: 637 - protein, 8 aa, Artificial Sequence
  Description of Artificial Sequence: Synthetic peptide
GFTFSSYD

SEQ ID NO: 638 - protein, 8 aa, Artificial Sequence
  Description of Artificial Sequence: Synthetic peptide
ISSSSSYI

SEQ ID NO: 639 - protein, 17 aa, Artificial Sequence
  Description of Artificial Sequence: Synthetic peptide
ARDVGVTTDYYYYGMDV

SEQ ID NO: 640 - protein, 7 aa, Artificial Sequence
  Description of Artificial Sequence: Synthetic peptide
QSVASSY

SEQ ID NO: 641 - protein, 3 aa, Artificial Sequence
  Description of Artificial Sequence: Synthetic peptide
GAS

SEQ ID NO: 642 - protein, 10 aa, Artificial Sequence
  Description of Artificial Sequence: Synthetic peptide
QQYGSSPPYT

SEQ ID NO: 643 - protein, 124 aa, Artificial Sequence
  Description of Artificial Sequence: Synthetic polypeptide
EVQLLESGGGLVKPGGSLRLSCSASGFTFSSYDMNWVRQAPGKGLEWVSSISSSSSYIYYADSVKGRFTISRDNAKNSLYLQMNSLRAEDTAVYHCARDVGVTTDYYYYGMDVWGQGTMVTVSS

SEQ ID NO: 644 - protein, 109 aa, Artificial Sequence; identical to SEQ ID NO: 372
  Description of Artificial Sequence: Synthetic polypeptide

SEQ ID NO: 645 - protein, 454 aa, Artificial Sequence
  Description of Artificial Sequence: Synthetic polypeptide
EVQLLESGGGLVKPGGSLRLSCSASGFTFSSYDMNWVRQAPGKGLEWVSSISSSSSYIYYADSVKGRFTISRDNAKNSLYLQMNSLRAEDTAVYHCARDVGVTTDYYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 646 - protein, 216 aa, Artificial Sequence; identical to SEQ ID NO: 374
  Description of Artificial Sequence: Synthetic polypeptide

SEQ ID NO: 647 - protein, 5 aa, Artificial Sequence
  Description of Artificial Sequence: Synthetic peptide
NYDMN

SEQ ID NO: 648 - protein, 17 aa, Artificial Sequence
  Description of Artificial Sequence: Synthetic peptide
SISSSSSYIYYADSVKG

SEQ ID NO: 649 - protein, 15 aa, Artificial Sequence
  Description of Artificial Sequence: Synthetic peptide
DVGVTTDYYYYGMDV

SEQ ID NO: 650 - protein, 12 aa, Artificial Sequence
  Description of Artificial Sequence: Synthetic peptide
RASQSVASSYLA

SEQ ID NO: 651 - protein, 7 aa, Artificial Sequence
  Description of Artificial Sequence: Synthetic peptide
GASSRAT

SEQ ID NO: 652 - protein, 10 aa, Artificial Sequence
  Description of Artificial Sequence: Synthetic peptide
QQYGSSPPYT

SEQ ID NO: 653 - protein, 7 aa, Artificial Sequence
  Description of Artificial Sequence: Synthetic peptide
GFTFSNY

SEQ ID NO: 654 - protein, 6 aa, Artificial Sequence
  Description of Artificial Sequence: Synthetic peptide
SSSSSY

SEQ ID NO: 655 - protein, 14 aa, Artificial Sequence
  Description of Artificial Sequence: Synthetic peptide
DVGVTTDYYYYGMD

SEQ ID NO: 656 - protein, 8 aa, Artificial Sequence
  Description of Artificial Sequence: Synthetic peptide
SQSVASSY

SEQ ID NO: 657 - protein, 3 aa, Artificial Sequence
  Description of Artificial Sequence: Synthetic peptide
GAS

SEQ ID NO: 658 - protein, 7 aa, Artificial Sequence
  Description of Artificial Sequence: Synthetic peptide
YGSSPPY

SEQ ID NO: 659 - protein, 10 aa, Artificial Sequence
  Description of Artificial Sequence: Synthetic peptide
GFTFSNYDMN

SEQ ID NO: 660 - protein, 10 aa, Artificial Sequence
  Description of Artificial Sequence: Synthetic peptide
SISSSSSYIY

SEQ ID NO: 661 - protein, 15 aa, Artificial Sequence
  Description of Artificial Sequence: Synthetic peptide
DVGVTTDYYYYGMDV

SEQ ID NO: 662 - protein, 12 aa, Artificial Sequence
  Description of Artificial Sequence: Synthetic peptide
RASQSVASSYLA

SEQ ID NO: 663 - protein, 7 aa, Artificial Sequence
  Description of Artificial Sequence: Synthetic peptide
GASSRAT

SEQ ID NO: 664 - protein, 10 aa, Artificial Sequence
  Description of Artificial Sequence: Synthetic peptide
QQYGSSPPYT

SEQ ID NO: 665 - protein, 6 aa, Artificial Sequence
  Description of Artificial Sequence: Synthetic peptide
SNYDMN

SEQ ID NO: 666 - protein, 13 aa, Artificial Sequence
  Description of Artificial Sequence: Synthetic peptide
WVSSISSSSSYIY

SEQ ID NO: 667 - protein, 16 aa, Artificial Sequence
  Description of Artificial Sequence: Synthetic peptide
ARDVGVTTDYYYYGMD

SEQ ID NO: 668 - protein, 8 aa, Artificial Sequence
  Description of Artificial Sequence: Synthetic peptide
ASSYLAWY

SEQ ID NO: 669 - protein, 10 aa, Artificial Sequence
  Description of Artificial Sequence: Synthetic peptide
LLIYGASSRA

SEQ ID NO: 670 - protein, 9 aa, Artificial Sequence
  Description of Artificial Sequence: Synthetic peptide
QQYGSSPPY

SEQ ID NO: 671 - protein, 8 aa, Artificial Sequence
  Description of Artificial Sequence: Synthetic peptide
GFTFSNYD

SEQ ID NO: 672 - protein, 8 aa, Artificial Sequence
  Description of Artificial Sequence: Synthetic peptide
ISSSSSYI

SEQ ID NO: 673 - protein, 17 aa, Artificial Sequence
  Description of Artificial Sequence: Synthetic peptide
ARDVGVTTDYYYYGMDV

SEQ ID NO: 674 - protein, 7 aa, Artificial Sequence
  Description of Artificial Sequence: Synthetic peptide
QSVASSY

SEQ ID NO: 675 - protein, 3 aa, Artificial Sequence
  Description of Artificial Sequence: Synthetic peptide
GAS

SEQ ID NO: 676 - protein, 10 aa, Artificial Sequence
  Description of Artificial Sequence: Synthetic peptide
QQYGSSPPYT

SEQ ID NO: 677 - protein, 124 aa, Artificial Sequence; identical to SEQ ID NO: 201
  Description of Artificial Sequence: Synthetic polypeptide

SEQ ID NO: 678 - protein, 109 aa, Artificial Sequence; identical to SEQ ID NO: 304
  Description of Artificial Sequence: Synthetic polypeptide

SEQ ID NO: 679 - protein, 454 aa, Artificial Sequence; identical to SEQ ID NO: 203
  Description of Artificial Sequence: Synthetic polypeptide

SEQ ID NO: 680 - protein, 216 aa, Artificial Sequence; identical to SEQ ID NO: 306
  Description of Artificial Sequence: Synthetic polypeptide

SEQ ID NO: 681 - protein, 5 aa, Artificial Sequence
  Description of Artificial Sequence: Synthetic peptide
SYSMY

SEQ ID NO: 682 - protein, 17 aa, Artificial Sequence
  Description of Artificial Sequence: Synthetic peptide
SIGSSSTYIFYADSVKG

SEQ ID NO: 683 - protein, 9 aa, Artificial Sequence
  Description of Artificial Sequence: Synthetic peptide
DGELGPFEY

SEQ ID NO: 684 - protein, 12 aa, Artificial Sequence
  Description of Artificial Sequence: Synthetic peptide
RASQSVSTSYLA

SEQ ID NO: 685 - protein, 7 aa, Artificial Sequence
  Description of Artificial Sequence: Synthetic peptide
GTSSRAT

SEQ ID NO: 686 - protein, 9 aa, Artificial Sequence
  Description of Artificial Sequence: Synthetic peptide
LQYGRSPLT

SEQ ID NO: 687 - protein, 7 aa, Artificial Sequence
  Description of Artificial Sequence: Synthetic peptide
GFTFSSY

SEQ ID NO: 688 - protein, 6 aa, Artificial Sequence
  Description of Artificial Sequence: Synthetic peptide
GSSSTY

SEQ ID NO: 689 - protein, 8 aa, Artificial Sequence
  Description of Artificial Sequence: Synthetic peptide
DGELGPFE

SEQ ID NO: 690 - protein, 8 aa, Artificial Sequence
  Description of Artificial Sequence: Synthetic peptide
SQSVSTSY

SEQ ID NO: 691 - protein, 3 aa, Artificial Sequence
  Description of Artificial Sequence: Synthetic peptide
GTS

SEQ ID NO: 692 - protein, 6 aa, Artificial Sequence
  Description of Artificial Sequence: Synthetic peptide
YGRSPL

SEQ ID NO: 693 - protein, 10 aa, Artificial Sequence
  Description of Artificial Sequence: Synthetic peptide
GFTFSSYSMY

SEQ ID NO: 694 - protein, 10 aa, Artificial Sequence
  Description of Artificial Sequence: Synthetic peptide
SIGSSSTYIF

SEQ ID NO: 695 - protein, 9 aa, Artificial Sequence
  Description of Artificial Sequence: Synthetic peptide
DGELGPFEY

SEQ ID NO: 696 - protein, 12 aa, Artificial Sequence
  Description of Artificial Sequence: Synthetic peptide
RASQSVSTSYLA

SEQ ID NO: 697 - protein, 7 aa, Artificial Sequence
  Description of Artificial Sequence: Synthetic peptide
GTSSRAT

SEQ ID NO: 698 - protein, 9 aa, Artificial Sequence
  Description of Artificial Sequence: Synthetic peptide
LQYGRSPLT

SEQ ID NO: 699 - protein, 6 aa, Artificial Sequence
  Description of Artificial Sequence: Synthetic peptide
SSYSMY

SEQ ID NO: 700 - protein, 13 aa, Artificial Sequence
  Description of Artificial Sequence: Synthetic peptide
WVSSIGSSSTYIF

SEQ ID NO: 701 - protein, 10 aa, Artificial Sequence
  Description of Artificial Sequence: Synthetic peptide
ARDGELGPFE

SEQ ID NO: 702 - protein, 8 aa, Artificial Sequence
  Description of Artificial Sequence: Synthetic peptide
STSYLAWF

SEQ ID NO: 703 - protein, 10 aa, Artificial Sequence
  Description of Artificial Sequence: Synthetic peptide
LLIFGTSSRA

SEQ ID NO: 704 - protein, 8 aa, Artificial Sequence
  Description of Artificial Sequence: Synthetic peptide
LQYGRSPL

SEQ ID NO: 705 - protein, 8 aa, Artificial Sequence
  Description of Artificial Sequence: Synthetic peptide
GFTFSSYS

SEQ ID NO: 706 - protein, 8 aa, Artificial Sequence
  Description of Artificial Sequence: Synthetic peptide
IGSSSTYI

SEQ ID NO: 707 - protein, 11 aa, Artificial Sequence
  Description of Artificial Sequence: Synthetic peptide
ARDGELGPFEY

SEQ ID NO: 708 - protein, 7 aa, Artificial Sequence
  Description of Artificial Sequence: Synthetic peptide
QSVSTSY

SEQ ID NO: 709 - protein, 3 aa, Artificial Sequence
  Description of Artificial Sequence: Synthetic peptide
GTS

SEQ ID NO: 710 - protein, 9 aa, Artificial Sequence
  Description of Artificial Sequence: Synthetic peptide
LQYGRSPLT

SEQ ID NO: 711 - protein, 118 aa, Artificial Sequence
  Description of Artificial Sequence: Synthetic polypeptide
EVQLVQSGGDLVKSGGSLRLSCAASGFTFSSYSMYWVRQAPGKGLEWVSSIGSSSTYIFYADSVKGRFTISRDNAMTSLYLQMNRLGAEDSAVYYCARDGELGPFEYWGQGTLVTVSS

SEQ ID NO: 712 - protein, 108 aa, Artificial Sequence
  Description of Artificial Sequence: Synthetic polypeptide
EIVLTQSPGTLSLSPGERATLSCRASQSVSTSYLAWFQQKPGQAPRLLIFGTSSRATGIPDRFSGSGSGTDFTLTISRLEPEDFAVYHCLQYGRSPLTFGGGTKVDIK

SEQ ID NO: 713 - protein, 448 aa, Artificial Sequence
  Description of Artificial Sequence: Synthetic polypeptide
EVQLVQSGGDLVKSGGSLRLSCAASGFTFSSYSMYWVRQAPGKGLEWVSSIGSSSTYIFYADSVKGRFTISRDNAMTSLYLQMNRLGAEDSAVYYCARDGELGPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 714 - protein, 215 aa, Artificial Sequence
  Description of Artificial Sequence: Synthetic polypeptide
EIVLTQSPGTLSLSPGERATLSCRASQSVSTSYLAWFQQKPGQAPRLLIFGTSSRATGIPDRFSGSGSGTDFTLTISRLEPEDFAVYHCLQYGRSPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 715 - protein, 5 aa, Artificial Sequence
  Description of Artificial Sequence: Synthetic peptide
NYDMN

SEQ ID NO: 716 - protein, 17 aa, Artificial Sequence
  Description of Artificial Sequence: Synthetic peptide
SISSSSSYIYYADSVKG

SEQ ID NO: 717 - protein, 17 aa, Artificial Sequence
  Description of Artificial Sequence: Synthetic peptide
EIGVTGTTYYQDYGMDV

SEQ ID NO: 718 - protein, 12 aa, Artificial Sequence
  Description of Artificial Sequence: Synthetic peptide
RASQSFSSNYLA

SEQ ID NO: 719 - protein, 7 aa, Artificial Sequence
  Description of Artificial Sequence: Synthetic peptide
GASSRAT

SEQ ID NO: 720 - protein, 10 aa, Artificial Sequence
  Description of Artificial Sequence: Synthetic peptide
QQYGSSPPFT

SEQ ID NO: 721 - protein, 7 aa, Artificial Sequence
  Description of Artificial Sequence: Synthetic peptide
GFTFSNY

SEQ ID NO: 722 - protein, 6 aa, Artificial Sequence
  Description of Artificial Sequence: Synthetic peptide
SSSSSY

SEQ ID NO: 723 - protein, 16 aa, Artificial Sequence
  Description of Artificial Sequence: Synthetic peptide
EIGVTGTTYYQDYGMD

SEQ ID NO: 724 - protein, 8 aa, Artificial Sequence
  Description of Artificial Sequence: Synthetic peptide
SQSFSSNY

SEQ ID NO: 725 - protein, 3 aa, Artificial Sequence
  Description of Artificial Sequence: Synthetic peptide
GAS

SEQ ID NO: 726 - protein, 7 aa, Artificial Sequence
  Description of Artificial Sequence: Synthetic peptide
YGSSPPF

SEQ ID NO: 727 - protein, 10 aa, Artificial Sequence
  Description of Artificial Sequence: Synthetic peptide
GFTFSNYDMN

SEQ ID NO: 728 - protein, 10 aa, Artificial Sequence
  Description of Artificial Sequence: Synthetic peptide
SISSSSSYIY

SEQ ID NO: 729 - protein, 17 aa, Artificial Sequence
  Description of Artificial Sequence: Synthetic peptide
EIGVTGTTYYQDYGMDV

SEQ ID NO: 730 - protein, 12 aa, Artificial Sequence
  Description of Artificial Sequence: Synthetic peptide
RASQSFSSNYLA

SEQ ID NO: 731 - protein, 7 aa, Artificial Sequence
  Description of Artificial Sequence: Synthetic peptide
GASSRAT

SEQ ID NO: 732 - protein, 10 aa, Artificial Sequence
  Description of Artificial Sequence: Synthetic peptide
QQYGSSPPFT

SEQ ID NO: 733 - protein, 6 aa, Artificial Sequence
  Description of Artificial Sequence: Synthetic peptide
SNYDMN

SEQ ID NO: 734 - protein, 13 aa, Artificial Sequence
  Description of Artificial Sequence: Synthetic peptide
WVSSISSSSSYIY

SEQ ID NO: 735 - protein, 18 aa, Artificial Sequence
  Description of Artificial Sequence: Synthetic peptide
AREIGVTGTTYYQDYGMD

SEQ ID NO: 736 - protein, 8 aa, Artificial Sequence
  Description of Artificial Sequence: Synthetic peptide
SSNYLAWY

SEQ ID NO: 737 - protein, 10 aa, Artificial Sequence
  Description of Artificial Sequence: Synthetic peptide
LLIYGASSRA

SEQ ID NO: 738 - protein, 9 aa, Artificial Sequence
  Description of Artificial Sequence: Synthetic peptide
QQYGSSPPF

SEQ ID NO: 739 - protein, 8 aa, Artificial Sequence
  Description of Artificial Sequence: Synthetic peptide
GFTFSNYD

SEQ ID NO: 740 - protein, 8 aa, Artificial Sequence
  Description of Artificial Sequence: Synthetic peptide
ISSSSSYI

SEQ ID NO: 741 - protein, 19 aa, Artificial Sequence
  Description of Artificial Sequence: Synthetic peptide
AREIGVTGTTYYQDYGMDV

SEQ ID NO: 742 - protein, 7 aa, Artificial Sequence
  Description of Artificial Sequence: Synthetic peptide
QSFSSNY

SEQ ID NO: 743 - protein, 3 aa, Artificial Sequence
  Description of Artificial Sequence: Synthetic peptide
GAS

SEQ ID NO: 744 - protein, 10 aa, Artificial Sequence
  Description of Artificial Sequence: Synthetic peptide
QQYGSSPPFT

SEQ ID NO: 745 - protein, 126 aa, Artificial Sequence
  Description of Artificial Sequence: Synthetic polypeptide
EVQLVQSGGGLVKPGGSLRLSCAASGFTFSNYDMNWVRQAPGKGLEWVSSISSSSSYIYYADSVKGRFTISRDNARNSLFLQMSSLRAEDTAVYYCAREIGVTGTTYYQDYGMDVWGQGTTVTVSS

SEQ ID NO: 746 - protein, 109 aa, Artificial Sequence
  Description of Artificial Sequence: Synthetic polypeptide
EIVMTQSPGTLSLSPGERATLSCRASQSFSSNYLAWYQQKPGQAPRLLIYGASSRATGIPDRFSGSGSGTDFTLTISRLEPEDFALYYCQQYGSSPPFTFGQGTKVEIK

SEQ ID NO: 747 - protein, 456 aa, Artificial Sequence
  Description of Artificial Sequence: Synthetic polypeptide
EVQLVQSGGGLVKPGGSLRLSCAASGFTFSNYDMNWVRQAPGKGLEWVSSISSSSSYIYYADSVKGRFTISRDNARNSLFLQMSSLRAEDTAVYYCAREIGVTGTTYYQDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 748 - protein, 216 aa, Artificial Sequence
  Description of Artificial Sequence: Synthetic polypeptide
EIVMTQSPGTLSLSPGERATLSCRASQSFSSNYLAWYQQKPGQAPRLLIYGASSRATGIPDRFSGSGSGTDFTLTISRLEPEDFALYYCQQYGSSPPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 749 - protein, 5 aa, Artificial Sequence
  Description of Artificial Sequence: Synthetic peptide
NYDMN

SEQ ID NO: 750 - protein, 17 aa, Artificial Sequence
  Description of Artificial Sequence: Synthetic peptide
SISSSSSYIYYADSVKG

SEQ ID NO: 751 - protein, 17 aa, Artificial Sequence
  Description of Artificial Sequence: Synthetic peptide
DLGITGTTMDYYYGMDV

SEQ ID NO: 752 - protein, 12 aa, Artificial Sequence
  Description of Artificial Sequence: Synthetic peptide
RASQSVSSSYLA

SEQ ID NO: 753 - protein, 7 aa, Artificial Sequence
  Description of Artificial Sequence: Synthetic peptide
GASSRAT

SEQ ID NO: 754 - protein, 10 aa, Artificial Sequence
  Description of Artificial Sequence: Synthetic peptide
QQYGSSPPYT

SEQ ID NO: 755 - protein, 7 aa, Artificial Sequence
  Description of Artificial Sequence: Synthetic peptide
GFTFSNY

SEQ ID NO: 756 - protein, 6 aa, Artificial Sequence
  Description of Artificial Sequence: Synthetic peptide
SSSSSY

SEQ ID NO: 757 - protein, 16 aa, Artificial Sequence
  Description of Artificial Sequence: Synthetic peptide
DLGITGTTMDYYYGMD

SEQ ID NO: 758 - protein, 8 aa, Artificial Sequence
  Description of Artificial Sequence: Synthetic peptide
SQSVSSSY

SEQ ID NO: 759 - protein, 3 aa, Artificial Sequence
  Description of Artificial Sequence: Synthetic peptide
GAS

SEQ ID NO: 760 - protein, 7 aa, Artificial Sequence
  Description of Artificial Sequence: Synthetic peptide
YGSSPPY

SEQ ID NO: 761 - protein, 10 aa, Artificial Sequence
  Description of Artificial Sequence: Synthetic peptide
GFTFSNYDMN

SEQ ID NO: 762 - protein, 10 aa, Artificial Sequence
  Description of Artificial Sequence: Synthetic peptide
SISSSSSYIY

SEQ ID NO: 763 - protein, 17 aa, Artificial Sequence
  Description of Artificial Sequence: Synthetic peptide
DLGITGTTMDYYYGMDV

SEQ ID NO: 764 - protein, 12 aa, Artificial Sequence
  Description of Artificial Sequence: Synthetic peptide
RASQSVSSSYLA

SEQ ID NO: 765 - protein, 7 aa, Artificial Sequence
  Description of Artificial Sequence: Synthetic peptide
GASSRAT

SEQ ID NO: 766 - protein, 10 aa, Artificial Sequence
  Description of Artificial Sequence: Synthetic peptide
QQYGSSPPYT

SEQ ID NO: 767 - protein, 6 aa, Artificial Sequence
  Description of Artificial Sequence: Synthetic peptide
SNYDMN

SEQ ID NO: 768 - protein, 13 aa, Artificial Sequence
  Description of Artificial Sequence: Synthetic peptide
WVSSISSSSSYIY

SEQ ID NO: 769 - protein, 18 aa, Artificial Sequence
  Description of Artificial Sequence: Synthetic peptide
ARDLGITGTTMDYYYGMD

SEQ ID NO: 770 - protein, 8 aa, Artificial Sequence
  Description of Artificial Sequence: Synthetic peptide
SSSYLAWY

SEQ ID NO: 771 - protein, 10 aa, Artificial Sequence
  Description of Artificial Sequence: Synthetic peptide
LLIYGASSRA

SEQ ID NO: 772 - protein, 9 aa, Artificial Sequence
  Description of Artificial Sequence: Synthetic peptide
QQYGSSPPY

SEQ ID NO: 773 - protein, 8 aa, Artificial Sequence
  Description of Artificial Sequence: Synthetic peptide
GFTFSNYD

SEQ ID NO: 774 - protein, 8 aa, Artificial Sequence
  Description of Artificial Sequence: Synthetic peptide
ISSSSSYI

SEQ ID NO: 775 - protein, 19 aa, Artificial Sequence
  Description of Artificial Sequence: Synthetic peptide
ARDLGITGTTMDYYYGMDV

SEQ ID NO: 776 - protein, 7 aa, Artificial Sequence
  Description of Artificial Sequence: Synthetic peptide
QSVSSSY

SEQ ID NO: 777 - protein, 3 aa, Artificial Sequence
  Description of Artificial Sequence: Synthetic peptide
GAS

SEQ ID NO: 778 - protein, 10 aa, Artificial Sequence
  Description of Artificial Sequence: Synthetic peptide
QQYGSSPPYT

SEQ ID NO: 779 - protein, 126 aa, Artificial Sequence
  Description of Artificial Sequence: Synthetic polypeptide
EVQLVESGGGLVKPGGSLRLSCAAAGFTFSNYDMNWVRQVPGKGLEWVSSISSSSSYIYYADSVKGRFTISRDNAKNSLYLQMNTLRAEDTAVYYCARDLGITGTTMDYYYGMDVWGQGTMVTVSS

SEQ ID NO: 780 - protein, 109 aa, Artificial Sequence
  Description of Artificial Sequence: Synthetic polypeptide
EIVMTQSPGTLSLSPGERATLSCRASQSVSSSYLAWYQQKPGQAPRLLIYGASSRATGIPDRFSGSGSGTDFTLTISRLEPEDFAVYYCQQYGSSPPYTFGQGTKVDIK

SEQ ID NO: 781 - protein, 456 aa, Artificial Sequence
  Description of Artificial Sequence: Synthetic polypeptide
EVQLVESGGGLVKPGGSLRLSCAAAGFTFSNYDMNWVRQVPGKGLEWVSSISSSSSYIYYADSVKGRFTISRDNAKNSLYLQMNTLRAEDTAVYYCARDLGITGTTMDYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 782 - protein, 216 aa, Artificial Sequence
  Description of Artificial Sequence: Synthetic polypeptide
EIVMTQSPGTLSLSPGERATLSCRASQSVSSSYLAWYQQKPGQAPRLLIYGASSRATGIPDRFSGSGSGTDFTLTISRLEPEDFAVYYCQQYGSSPPYTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 783 - protein, 5 aa, Artificial Sequence
  Description of Artificial Sequence: Synthetic peptide
SYDMN

SEQ ID NO: 784 - protein, 17 aa, Artificial Sequence
  Description of Artificial Sequence: Synthetic peptide
SISSSSSYIYYADSVKG

SEQ ID NO: 785 - protein, 15 aa, Artificial Sequence
  Description of Artificial Sequence: Synthetic peptide
DRGIGGDYYSYAMDV

SEQ ID NO: 786 - protein, 12 aa, Artificial Sequence
  Description of Artificial Sequence: Synthetic peptide
RASQSVSSSYLA

SEQ ID NO: 787 - protein, 7 aa, Artificial Sequence
  Description of Artificial Sequence: Synthetic peptide
GASSRAT

SEQ ID NO: 788 - protein, 10 aa, Artificial Sequence
  Description of Artificial Sequence: Synthetic peptide
QQYGSSPPYT

SEQ ID NO: 789 - protein, 7 aa, Artificial Sequence
  Description of Artificial Sequence: Synthetic peptide
GFTFNSY

SEQ ID NO: 790 - protein, 6 aa, Artificial Sequence
  Description of Artificial Sequence: Synthetic peptide
SSSSSY

SEQ ID NO: 791 - protein, 14 aa, Artificial Sequence
  Description of Artificial Sequence: Synthetic peptide
DRGIGGDYYSYAMD

SEQ ID NO: 792 - protein, 8 aa, Artificial Sequence
  Description of Artificial Sequence: Synthetic peptide
SQSVSSSY

SEQ ID NO: 793 - protein, 3 aa, Artificial Sequence
  Description of Artificial Sequence: Synthetic peptide
GAS

SEQ ID NO: 794 - protein, 7 aa, Artificial Sequence
  Description of Artificial Sequence: Synthetic peptide
YGSSPPY

SEQ ID NO: 795 - protein, 10 aa, Artificial Sequence
  Description of Artificial Sequence: Synthetic peptide
GFTFNSYDMN

SEQ ID NO: 796 - protein, 10 aa, Artificial Sequence
  Description of Artificial Sequence: Synthetic peptide
SISSSSSYIY

SEQ ID NO: 797 - protein, 15 aa, Artificial Sequence
  Description of Artificial Sequence: Synthetic peptide
DRGIGGDYYSYAMDV

SEQ ID NO: 798 - protein, 12 aa, Artificial Sequence
  Description of Artificial Sequence: Synthetic peptide
RASQSVSSSYLA

SEQ ID NO: 799 - protein, 7 aa, Artificial Sequence
  Description of Artificial Sequence: Synthetic peptide
GASSRAT

SEQ ID NO: 800 - protein, 10 aa, Artificial Sequence
  Description of Artificial Sequence: Synthetic peptide
QQYGSSPPYT

SEQ ID NO: 801 - protein, 6 aa, Artificial Sequence
  Description of Artificial Sequence: Synthetic peptide
NSYDMN

SEQ ID NO: 802 - protein, 13 aa, Artificial Sequence
  Description of Artificial Sequence: Synthetic peptide
WVSSISSSSSYIY

SEQ ID NO: 803 - protein, 16 aa, Artificial Sequence
  Description of Artificial Sequence: Synthetic peptide
ARDRGIGGDYYSYAMD

SEQ ID NO: 804 - protein, 8 aa, Artificial Sequence
  Description of Artificial Sequence: Synthetic peptide
SSSYLAWY

SEQ ID NO: 805 - protein, 10 aa, Artificial Sequence
  Description of Artificial Sequence: Synthetic peptide
LLIYGASSRA

SEQ ID NO: 806 - protein, 9 aa, Artificial Sequence
  Description of Artificial Sequence: Synthetic peptide
QQYGSSPPY

SEQ ID NO: 807 - protein, 8 aa, Artificial Sequence
  Description of Artificial Sequence: Synthetic peptide
GFTFNSYD

SEQ ID NO: 808 - protein, 8 aa, Artificial Sequence
  Description of Artificial Sequence: Synthetic peptide
ISSSSSYI

SEQ ID NO: 809 - protein, 17 aa, Artificial Sequence
  Description of Artificial Sequence: Synthetic peptide
ARDRGIGGDYYSYAMDV

SEQ ID NO: 810 - protein, 7 aa, Artificial Sequence
  Description of Artificial Sequence: Synthetic peptide
QSVSSSY

SEQ ID NO: 811 - protein, 3 aa, Artificial Sequence
  Description of Artificial Sequence: Synthetic peptide
GAS

SEQ ID NO: 812 - protein, 10 aa, Artificial Sequence
  Description of Artificial Sequence: Synthetic peptide
QQYGSSPPYT

SEQ ID NO: 813 - protein, 124 aa, Artificial Sequence
  Description of Artificial Sequence: Synthetic polypeptide
EVQLVESGGGLVKPGGSLRLSCAASGFTFNSYDMNWVRQAPGKGLEWVSSISSSSSYIYYADSVKGRCTISRDNARNSLYLQMNSLRAEDTAIYYCARDRGIGGDYYSYAMDVWGQGTMVTVSS

SEQ ID NO: 814 - protein, 109 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPYTFGQGTKLEIK

SEQ ID NO: 815 - protein, 454 aa, Artificial Sequence
  Description of Artificial Sequence: Synthetic polypeptide
EVQLVESGGGLVKPGGSLRLSCAASGFTFNSYDMNWVRQAPGKGLEWVSSISSSSSYIYYADSVKGRCTISRDNARNSLYLQMNSLRAEDTAIYYCARDRGIGGDYYSYAMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 816 - protein, 216 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 817 - protein, 5 aa, Artificial Sequence
  Description of Artificial Sequence: Synthetic peptide
NYDMN

SEQ ID NO: 818 - protein, 17 aa, Artificial Sequence
  Description of Artificial Sequence: Synthetic peptide
SISSSSSYIYYADSVKG

SEQ ID NO: 819 - protein, 15 aa, Artificial Sequence
  Description of Artificial Sequence: Synthetic peptide
DVGVTTDYYYYGMDV

SEQ ID NO: 820 - protein, 12 aa, Artificial Sequence
  Description of Artificial Sequence: Synthetic peptide
RASQSVASSYLA

SEQ ID NO: 821 - protein, 7 aa, Artificial Sequence
  Description of Artificial Sequence: Synthetic peptide
GASSRAT

SEQ ID NO: 822 - protein, 10 aa, Artificial Sequence
  Description of Artificial Sequence: Synthetic peptide
QQYGSSPPYT

SEQ ID NO: 823 - protein, 7 aa, Artificial Sequence
  Description of Artificial Sequence: Synthetic peptide
GFTFSNY

SEQ ID NO: 824 - protein, 6 aa, Artificial Sequence
  Description of Artificial Sequence: Synthetic peptide
SSSSSY

SEQ ID NO: 825 - protein, 14 aa, Artificial Sequence
  Description of Artificial Sequence: Synthetic peptide
DVGVTTDYYYYGMD

SEQ ID NO: 826 - protein, 8 aa, Artificial Sequence
  Description of Artificial Sequence: Synthetic peptide
SQSVASSY

SEQ ID NO: 827 - protein, 3 aa, Artificial Sequence
  Description of Artificial Sequence: Synthetic peptide
GAS

SEQ ID NO: 828 - protein, 7 aa, Artificial Sequence
  Description of Artificial Sequence: Synthetic peptide
YGSSPPY

SEQ ID NO: 829 - protein, 10 aa, Artificial Sequence
  Description of Artificial Sequence: Synthetic peptide
GFTFSNYDMN

SEQ ID NO: 830 - protein, 10 aa, Artificial Sequence
  Description of Artificial Sequence: Synthetic peptide
SISSSSSYIY

SEQ ID NO: 831 - protein, 15 aa, Artificial Sequence
  Description of Artificial Sequence: Synthetic peptide
DVGVTTDYYYYGMDV

SEQ ID NO: 832 - protein, 12 aa, Artificial Sequence
  Description of Artificial Sequence: Synthetic peptide
RASQSVASSYLA

SEQ ID NO: 833 - protein, 7 aa, Artificial Sequence
  Description of Artificial Sequence: Synthetic peptide
GASSRAT

SEQ ID NO: 834 - protein, 10 aa, Artificial Sequence
  Description of Artificial Sequence: Synthetic peptide
QQYGSSPPYT

SEQ ID NO: 835 - protein, 6 aa, Artificial Sequence
  Description of Artificial Sequence: Synthetic peptide
SNYDMN

SEQ ID NO: 836 - protein, 13 aa, Artificial Sequence
  Description of Artificial Sequence: Synthetic peptide
WVSSISSSSSYIY

SEQ ID NO: 837 - protein, 16 aa, Artificial Sequence
  Description of Artificial Sequence: Synthetic peptide
ARDVGVTTDYYYYGMD

SEQ ID NO: 838 - protein, 8 aa, Artificial Sequence
  Description of Artificial Sequence: Synthetic peptide
ASSYLAWY

SEQ ID NO: 839 - protein, 10 aa, Artificial Sequence
  Description of Artificial Sequence: Synthetic peptide
LLIYGASSRA

SEQ ID NO: 840 - protein, 9 aa, Artificial Sequence
  Description of Artificial Sequence: Synthetic peptide
QQYGSSPPY

SEQ ID NO: 841 - protein, 8 aa, Artificial Sequence
  Description of Artificial Sequence: Synthetic peptide
GFTFSNYD

SEQ ID NO: 842 - protein, 8 aa, Artificial Sequence
  Description of Artificial Sequence: Synthetic peptide
ISSSSSYI

SEQ ID NO: 843 - protein, 17 aa, Artificial Sequence
  Description of Artificial Sequence: Synthetic peptide
ARDVGVTTDYYYYGMDV

SEQ ID NO: 844 - protein, 7 aa, Artificial Sequence
  Description of Artificial Sequence: Synthetic peptide
QSVASSY

SEQ ID NO: 845 - protein, 3 aa, Artificial Sequence
  Description of Artificial Sequence: Synthetic peptide
GAS

SEQ ID NO: 846 - protein, 10 aa, Artificial Sequence
  Description of Artificial Sequence: Synthetic peptide
QQYGSSPPYT

SEQ ID NO: 847 - protein, 124 aa, Artificial Sequence; identical to SEQ ID NO: 201
  Description of Artificial Sequence: Synthetic polypeptide

SEQ ID NO: 848 - protein, 109 aa, Artificial Sequence; identical to SEQ ID NO: 440
  Description of Artificial Sequence: Synthetic polypeptide

SEQ ID NO: 849 - protein, 454 aa, Artificial Sequence; identical to SEQ ID NO: 203
  Description of Artificial Sequence: Synthetic polypeptide

SEQ ID NO: 850 - protein, 216 aa, Artificial Sequence; identical to SEQ ID NO: 442
  Description of Artificial Sequence: Synthetic polypeptide

SEQ ID NO: 851 - protein, 5 aa, Artificial Sequence
  Description of Artificial Sequence: Synthetic peptide
NYDMN

SEQ ID NO: 852 - protein, 17 aa, Artificial Sequence
  Description of Artificial Sequence: Synthetic peptide
SISSSSSYIYYADSVKG

SEQ ID NO: 853 - protein, 15 aa, Artificial Sequence
  Description of Artificial Sequence: Synthetic peptide
DVGVTTDYYYYGMDV

SEQ ID NO: 854 - protein, 12 aa, Artificial Sequence
  Description of Artificial Sequence: Synthetic peptide
RASQSVASSYLA

SEQ ID NO: 855 - protein, 7 aa, Artificial Sequence
  Description of Artificial Sequence: Synthetic peptide
GASSRAT

SEQ ID NO: 856 - protein, 10 aa, Artificial Sequence
  Description of Artificial Sequence: Synthetic peptide
QQYGSSPPYT

SEQ ID NO: 857 - protein, 7 aa, Artificial Sequence
  Description of Artificial Sequence: Synthetic peptide
GFTFSNY

SEQ ID NO: 858 - protein, 6 aa, Artificial Sequence
  Description of Artificial Sequence: Synthetic peptide
SSSSSY

SEQ ID NO: 859 - protein, 14 aa, Artificial Sequence
  Description of Artificial Sequence: Synthetic peptide
DVGVTTDYYYYGMD

SEQ ID NO: 860 - protein, 8 aa, Artificial Sequence
  Description of Artificial Sequence: Synthetic peptide
SQSVASSY

SEQ ID NO: 861 - protein, 3 aa, Artificial Sequence
  Description of Artificial Sequence: Synthetic peptide
GAS

SEQ ID NO: 862 - protein, 7 aa, Artificial Sequence
  Description of Artificial Sequence: Synthetic peptide
YGSSPPY

SEQ ID NO: 863 - protein, 10 aa, Artificial Sequence
  Description of Artificial Sequence: Synthetic peptide
GFTFSNYDMN

SEQ ID NO: 864 - protein, 10 aa, Artificial Sequence
  Description of Artificial Sequence: Synthetic peptide
SISSSSSYIY

SEQ ID NO: 865 - protein, 15 aa, Artificial Sequence
  Description of Artificial Sequence: Synthetic peptide
DVGVTTDYYYYGMDV

SEQ ID NO: 866 - protein, 12 aa, Artificial Sequence
  Description of Artificial Sequence: Synthetic peptide
RASQSVASSYLA

SEQ ID NO: 867 - protein, 7 aa, Artificial Sequence
  Description of Artificial Sequence: Synthetic peptide
GASSRAT

SEQ ID NO: 868 - protein, 10 aa, Artificial Sequence
  Description of Artificial Sequence: Synthetic peptide
QQYGSSPPYT

SEQ ID NO: 869 - protein, 6 aa, Artificial Sequence
  Description of Artificial Sequence: Synthetic peptide
SNYDMN

SEQ ID NO: 870 - protein, 13 aa, Artificial Sequence
  Description of Artificial Sequence: Synthetic peptide
WVSSISSSSSYIY

SEQ ID NO: 871 - protein, 16 aa, Artificial Sequence
  Description of Artificial Sequence: Synthetic peptide
ARDVGVTTDYYYYGMD

SEQ ID NO: 872 - protein, 8 aa, Artificial Sequence
  Description of Artificial Sequence: Synthetic peptide
ASSYLAWY

SEQ ID NO: 873 - protein, 10 aa, Artificial Sequence
  Description of Artificial Sequence: Synthetic peptide
LLIYGASSRA

SEQ ID NO: 874 - protein, 9 aa, Artificial Sequence
  Description of Artificial Sequence: Synthetic peptide
QQYGSSPPY

SEQ ID NO: 875 - protein, 8 aa, Artificial Sequence
  Description of Artificial Sequence: Synthetic peptide
GFTFSNYD

SEQ ID NO: 876 - protein, 8 aa, Artificial Sequence
  Description of Artificial Sequence: Synthetic peptide
ISSSSSYI

SEQ ID NO: 877 - protein, 17 aa, Artificial Sequence
  Description of Artificial Sequence: Synthetic peptide
ARDVGVTTDYYYYGMDV

SEQ ID NO: 878 - protein, 7 aa, Artificial Sequence
  Description of Artificial Sequence: Synthetic peptide
QSVASSY

SEQ ID NO: 879 - protein, 3 aa, Artificial Sequence
  Description of Artificial Sequence: Synthetic peptide
GAS

SEQ ID NO: 880 - protein, 10 aa, Artificial Sequence
  Description of Artificial Sequence: Synthetic peptide
QQYGSSPPYT

SEQ ID NO: 881 - protein, 124 aa, Artificial Sequence
  Description of Artificial Sequence: Synthetic polypeptide
QVQLVESGGGLVKPGGSLRLSCSASGFTFSNYDMNWVRQAPGKGLEWVSSISSSSSYIYYADSVKGRFTISRDNAKNSLYLQMNSLRAEDTAVYHCARDVGVTTDYYYYGMDVWGQGTTVTVSS

SEQ ID NO: 882 - protein, 109 aa, Artificial Sequence
  Description of Artificial Sequence: Synthetic polypeptide
EIVMTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTRLEIK

SEQ ID NO: 883 - protein, 454 aa, Artificial Sequence
  Description of Artificial Sequence: Synthetic polypeptide
QVQLVESGGGLVKPGGSLRLSCSASGFTFSNYDMNWVRQAPGKGLEWVSSISSSSSYIYYADSVKGRFTISRDNAKNSLYLQMNSLRAEDTAVYHCARDVGVTTDYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 884 - protein, 216 aa, Artificial Sequence
  Description of Artificial Sequence: Synthetic polypeptide
EIVMTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 885 - protein, 5 aa, Artificial Sequence
  Description of Artificial Sequence: Synthetic peptide
NYGMN

SEQ ID NO: 886 - protein, 17 aa, Artificial Sequence
  Description of Artificial Sequence: Synthetic peptide
YISSGSSYKYYADSMKG

SEQ ID NO: 887 - protein, 14 aa, Artificial Sequence
  Description of Artificial Sequence: Synthetic peptide
DPVVTEYYYYGMDV

SEQ ID NO: 888 - protein, 11 aa, Artificial Sequence
  Description of Artificial Sequence: Synthetic peptide
RASQGINSWLA

SEQ ID NO: 889 - protein, 7 aa, Artificial Sequence
  Description of Artificial Sequence: Synthetic peptide
AASSLQS

SEQ ID NO: 890 - protein, 9 aa, Artificial Sequence
  Description of Artificial Sequence: Synthetic peptide
QQANSFPWT

SEQ ID NO: 891 - protein, 7 aa, Artificial Sequence
  Description of Artificial Sequence: Synthetic peptide
GFTFSNY

SEQ ID NO: 892 - protein, 6 aa, Artificial Sequence
  Description of Artificial Sequence: Synthetic peptide
SSGSSY

SEQ ID NO: 893 - protein, 13 aa, Artificial Sequence
  Description of Artificial Sequence: Synthetic peptide
DPVVTEYYYYGMD

SEQ ID NO: 894 - protein, 7 aa, Artificial Sequence
  Description of Artificial Sequence: Synthetic peptide
SQGINSW

SEQ ID NO: 895 - protein, 3 aa, Artificial Sequence
  Description of Artificial Sequence: Synthetic peptide
AAS

SEQ ID NO: 896 - protein, 6 aa, Artificial Sequence
  Description of Artificial Sequence: Synthetic peptide
ANSFPW

SEQ ID NO: 897 - protein, 10 aa, Artificial Sequence
  Description of Artificial Sequence: Synthetic peptide
GFTFSNYGMN

SEQ ID NO: 898 - protein, 10 aa, Artificial Sequence
  Description of Artificial Sequence: Synthetic peptide
YISSGSSYKY

SEQ ID NO: 899 - protein, 14 aa, Artificial Sequence
  Description of Artificial Sequence: Synthetic peptide
DPVVTEYYYYGMDV

SEQ ID NO: 900 - protein, 11 aa, Artificial Sequence
  Description of Artificial Sequence: Synthetic peptide
RASQGINSWLA

SEQ ID NO: 901 - protein, 7 aa, Artificial Sequence
  Description of Artificial Sequence: Synthetic peptide
AASSLQS

SEQ ID NO: 902 - protein, 9 aa, Artificial Sequence
  Description of Artificial Sequence: Synthetic peptide
QQANSFPWT

SEQ ID NO: 903 - protein, 6 aa, Artificial Sequence
  Description of Artificial Sequence: Synthetic peptide
SNYGMN

SEQ ID NO: 904 - protein, 13 aa, Artificial Sequence
  Description of Artificial Sequence: Synthetic peptide
WVSYISSGSSYKY

SEQ ID NO: 905 - protein, 15 aa, Artificial Sequence
  Description of Artificial Sequence: Synthetic peptide
ARDPVVTEYYYYGMD

SEQ ID NO: 906 - protein, 7 aa, Artificial Sequence
  Description of Artificial Sequence: Synthetic peptide
NSWLAWY

SEQ ID NO: 907 - protein, 10 aa, Artificial Sequence
  Description of Artificial Sequence: Synthetic peptide
LLIYAASSLQ

SEQ ID NO: 908 - protein, 8 aa, Artificial Sequence
  Description of Artificial Sequence: Synthetic peptide
QQANSFPW

SEQ ID NO: 909 - protein, 8 aa, Artificial Sequence
  Description of Artificial Sequence: Synthetic peptide
GFTFSNYG

SEQ ID NO: 910 - protein, 8 aa, Artificial Sequence
  Description of Artificial Sequence: Synthetic peptide
ISSGSSYK

SEQ ID NO: 911 - protein, 16 aa, Artificial Sequence
  Description of Artificial Sequence: Synthetic peptide
ARDPVVTEYYYYGMDV

SEQ ID NO: 912 - protein, 6 aa, Artificial Sequence
  Description of Artificial Sequence: Synthetic peptide
QGINSW

SEQ ID NO: 913 - protein, 3 aa, Artificial Sequence
  Description of Artificial Sequence: Synthetic peptide
AAS

SEQ ID NO: 914 - protein, 9 aa, Artificial Sequence
  Description of Artificial Sequence: Synthetic peptide
QQANSFPWT

SEQ ID NO: 915 - protein, 123 aa, Artificial Sequence
  Description of Artificial Sequence: Synthetic polypeptide
EVQLVESGGGLVKPGGSLRLSCAASGFTFSNYGMNWVRQAPGKGLEWVSYISSGSSYKYYADSMKGRFTISRDNAMNLLYLQMNSLRPEDSAMYYCARDPVVTEYYYYGMDVWGQGTTVTVSS

SEQ ID NO: 916 - protein, 107 aa, Artificial Sequence
  Description of Artificial Sequence: Synthetic polypeptide
DIVMTQSPSSVSASVGDRVTITCRASQGINSWLAWYQQKPGNAPKLLIYAASSLQSGVPSRFSGIGSGTDFIFTISSLQPEDFASYYCQQANSFPWTFGQGTKVEIK

SEQ ID NO: 917 - protein, 453 aa, Artificial Sequence
  Description of Artificial Sequence: Synthetic polypeptide
EVQLVESGGGLVKPGGSLRLSCAASGFTFSNYGMNWVRQAPGKGLEWVSYISSGSSYKYYADSMKGRFTISRDNAMNLLYLQMNSLRPEDSAMYYCARDPVVTEYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 918 - protein, 214 aa, Artificial Sequence
  Description of Artificial Sequence: Synthetic polypeptide
DIVMTQSPSSVSASVGDRVTITCRASQGINSWLAWYQQKPGNAPKLLIYAASSLQSGVPSRFSGIGSGTDFIFTISSLQPEDFASYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 919 - protein, 5 aa, Artificial Sequence
  Description of Artificial Sequence: Synthetic peptide
SSYWT

SEQ ID NO: 920 - protein, 16 aa, Artificial Sequence
  Description of Artificial Sequence: Synthetic peptide
YMFYLGSTNYNPSLKS

SEQ ID NO: 921 - protein, 10 aa, Artificial Sequence
  Description of Artificial Sequence: Synthetic peptide
ERPVLDAFDI

SEQ ID NO: 922 - protein, 11 aa, Artificial Sequence
  Description of Artificial Sequence: Synthetic peptide
RASQDITNYLA

SEQ ID NO: 923 - protein, 7 aa, Artificial Sequence
  Description of Artificial Sequence: Synthetic peptide
AASSLQG

SEQ ID NO: 924 - protein, 9 aa, Artificial Sequence
  Description of Artificial Sequence: Synthetic peptide
LQHDTYPYT

SEQ ID NO: 925 - protein, 7 aa, Artificial Sequence
  Description of Artificial Sequence: Synthetic peptide
GGSIKSS

SEQ ID NO: 926 - protein, 5 aa, Artificial Sequence
  Description of Artificial Sequence: Synthetic peptide
FYLGS

SEQ ID NO: 927 - protein, 9 aa, Artificial Sequence
  Description of Artificial Sequence: Synthetic peptide
ERPVLDAFD

SEQ ID NO: 928 - protein, 7 aa, Artificial Sequence
  Description of Artificial Sequence: Synthetic peptide
SQDITNY

SEQ ID NO: 929 - protein, 3 aa, Artificial Sequence
  Description of Artificial Sequence: Synthetic peptide
AAS

SEQ ID NO: 930 - protein, 6 aa, Artificial Sequence
  Description of Artificial Sequence: Synthetic peptide
HDTYPY

SEQ ID NO: 931 - protein, 10 aa, Artificial Sequence
  Description of Artificial Sequence: Synthetic peptide
GGSIKSSYWT

SEQ ID NO: 932 - protein, 9 aa, Artificial Sequence
  Description of Artificial Sequence: Synthetic peptide
YMFYLGSTN

SEQ ID NO: 933 - protein, 10 aa, Artificial Sequence
  Description of Artificial Sequence: Synthetic peptide
ERPVLDAFDI

SEQ ID NO: 934 - protein, 11 aa, Artificial Sequence
  Description of Artificial Sequence: Synthetic peptide
RASQDITNYLA

SEQ ID NO: 935 - protein, 7 aa, Artificial Sequence
  Description of Artificial Sequence: Synthetic peptide
AASSLQG

SEQ ID NO: 936 - protein, 9 aa, Artificial Sequence
  Description of Artificial Sequence: Synthetic peptide
LQHDTYPYT

SEQ ID NO: 937 - protein, 6 aa, Artificial Sequence
  Description of Artificial Sequence: Synthetic peptide
KSSYWT

SEQ ID NO: 938 - protein, 12 aa, Artificial Sequence
  Description of Artificial Sequence: Synthetic peptide
WIGYMFYLGSTN

SEQ ID NO: 939 - protein, 11 aa, Artificial Sequence
  Description of Artificial Sequence: Synthetic peptide
SRERPVLDAFD

SEQ ID NO: 940 - protein, 7 aa, Artificial Sequence
  Description of Artificial Sequence: Synthetic peptide
TNYLAWF

SEQ ID NO: 941 - protein, 10 aa, Artificial Sequence
  Description of Artificial Sequence: Synthetic peptide
RLIYAASSLQ

SEQ ID NO: 942 - protein, 8 aa, Artificial Sequence
  Description of Artificial Sequence: Synthetic peptide
LQHDTYPY

SEQ ID NO: 943 - protein, 8 aa, Artificial Sequence
  Description of Artificial Sequence: Synthetic peptide
GGSIKSSY

SEQ ID NO: 944 - protein, 7 aa, Artificial Sequence
  Description of Artificial Sequence: Synthetic peptide
MFYLGST

SEQ ID NO: 945 - protein, 12 aa, Artificial Sequence
  Description of Artificial Sequence: Synthetic peptide
SRERPVLDAFDI

SEQ ID NO: 946 - protein, 6 aa, Artificial Sequence
  Description of Artificial Sequence: Synthetic peptide
QDITNY

SEQ ID NO: 947 - protein, 3 aa, Artificial Sequence
  Description of Artificial Sequence: Synthetic peptide
AAS

SEQ ID NO: 948 - protein, 9 aa, Artificial Sequence
  Description of Artificial Sequence: Synthetic peptide
LQHDTYPYT

SEQ ID NO: 949 - protein, 118 aa, Artificial Sequence
  Description of Artificial Sequence: Synthetic polypeptide
QVQLQESGPGLVKPSETLSLTCTVSGGSIKSSYWTWIRQPPGKGLEWIGYMFYLGSTNYNPSLKSRVTMSIDTSRNQFSLKLSSVTAADTAVYYCSRERPVLDAFDIWGQGTMVTVSS

SEQ ID NO: 950 - protein, 107 aa, Artificial Sequence
  Description of Artificial Sequence: Synthetic polypeptide
DIQMTQSPSAMSASVGDRVTITCRASQDITNYLAWFQQKPGKVPKRLIYAASSLQGGVPSRFSGSGSGTEFTLTISSLQPEDFSTYYCLQHDTYPYTFGQGTKVDIK

SEQ ID NO: 951 - protein, 448 aa, Artificial Sequence
  Description of Artificial Sequence: Synthetic polypeptide
QVQLQESGPGLVKPSETLSLTCTVSGGSIKSSYWTWIRQPPGKGLEWIGYMFYLGSTNYNPSLKSRVTMSIDTSRNQFSLKLSSVTAADTAVYYCSRERPVLDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 952 - protein, 214 aa, Artificial Sequence
  Description of Artificial Sequence: Synthetic polypeptide
DIQMTQSPSAMSASVGDRVTITCRASQDITNYLAWFQQKPGKVPKRLIYAASSLQGGVPSRFSGSGSGTEFTLTISSLQPEDFSTYYCLQHDTYPYTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 953 - protein, 5 aa, Artificial Sequence
  Description of Artificial Sequence: Synthetic peptide
NYDMN

SEQ ID NO: 954 - protein, 17 aa, Artificial Sequence
  Description of Artificial Sequence: Synthetic peptide
SISSSSSYIYYADSVKG

SEQ ID NO: 955 - protein, 15 aa, Artificial Sequence
  Description of Artificial Sequence: Synthetic peptide
DVGVTTDYYYYGMDV

SEQ ID NO: 956 - protein, 12 aa, Artificial Sequence
  Description of Artificial Sequence: Synthetic peptide
RASQSVASSYLA

SEQ ID NO: 957 - protein, 7 aa, Artificial Sequence
  Description of Artificial Sequence: Synthetic peptide
GASSRAT

SEQ ID NO: 958 - protein, 10 aa, Artificial Sequence
  Description of Artificial Sequence: Synthetic peptide
QQYGSSPPYT

SEQ ID NO: 959 - protein, 7 aa, Artificial Sequence
  Description of Artificial Sequence: Synthetic peptide
GFTFSNY

SEQ ID NO: 960 - protein, 6 aa, Artificial Sequence
  Description of Artificial Sequence: Synthetic peptide
SSSSSY

SEQ ID NO: 961 - protein, 14 aa, Artificial Sequence
  Description of Artificial Sequence: Synthetic peptide
DVGVTTDYYYYGMD

SEQ ID NO: 962 - protein, 8 aa, Artificial Sequence
  Description of Artificial Sequence: Synthetic peptide
SQSVASSY

SEQ ID NO: 963 - protein, 3 aa, Artificial Sequence
  Description of Artificial Sequence: Synthetic peptide
GAS

SEQ ID NO: 964 - protein, 7 aa, Artificial Sequence
  Description of Artificial Sequence: Synthetic peptide
YGSSPPY

SEQ ID NO: 965 - protein, 10 aa, Artificial Sequence
  Description of Artificial Sequence: Synthetic peptide
GFTFSNYDMN

SEQ ID NO: 966 - protein, 10 aa, Artificial Sequence
  Description of Artificial Sequence: Synthetic peptide
SISSSSSYIY

SEQ ID NO: 967 - protein, 15 aa, Artificial Sequence
  Description of Artificial Sequence: Synthetic peptide
DVGVTTDYYYYGMDV

SEQ ID NO: 968 - protein, 12 aa, Artificial Sequence
  Description of Artificial Sequence: Synthetic peptide
RASQSVASSYLA

SEQ ID NO: 969 - protein, 7 aa, Artificial Sequence
  Description of Artificial Sequence: Synthetic peptide
GASSRAT

SEQ ID NO: 970 - protein, 10 aa, Artificial Sequence
  Description of Artificial Sequence: Synthetic peptide
QQYGSSPPYT

SEQ ID NO: 971 - protein, 6 aa, Artificial Sequence
  Description of Artificial Sequence: Synthetic peptide
SNYDMN

SEQ ID NO: 972 - protein, 13 aa, Artificial Sequence
  Description of Artificial Sequence: Synthetic peptide
WVSSISSSSSYIY

SEQ ID NO: 973 - protein, 16 aa, Artificial Sequence
  Description of Artificial Sequence: Synthetic peptide
ARDVGVTTDYYYYGMD

SEQ ID NO: 974 - protein, 8 aa, Artificial Sequence
  Description of Artificial Sequence: Synthetic peptide
ASSYLAWY

SEQ ID NO: 975 - protein, 10 aa, Artificial Sequence
  Description of Artificial Sequence: Synthetic peptide
LLIYGASSRA

SEQ ID NO: 976 - protein, 9 aa, Artificial Sequence
  Description of Artificial Sequence: Synthetic peptide
QQYGSSPPY

SEQ ID NO: 977 - protein, 8 aa, Artificial Sequence
  Description of Artificial Sequence: Synthetic peptide
GFTFSNYD

SEQ ID NO: 978 - protein, 8 aa, Artificial Sequence
  Description of Artificial Sequence: Synthetic peptide
ISSSSSYI

SEQ ID NO: 979 - protein, 17 aa, Artificial Sequence
  Description of Artificial Sequence: Synthetic peptide
ARDVGVTTDYYYYGMDV

SEQ ID NO: 980 - protein, 7 aa, Artificial Sequence
  Description of Artificial Sequence: Synthetic peptide
QSVASSY

SEQ ID NO: 981 - protein, 3 aa, Artificial Sequence
  Description of Artificial Sequence: Synthetic peptide
GAS

SEQ ID NO: 982 - protein, 10 aa, Artificial Sequence
  Description of Artificial Sequence: Synthetic peptide
QQYGSSPPYT

SEQ ID NO: 983 - protein, 124 aa, Artificial Sequence; identical to SEQ ID NO: 371
  Description of Artificial Sequence: Synthetic polypeptide

SEQ ID NO: 984 - protein, 109 aa, Artificial Sequence
  Description of Artificial Sequence: Synthetic polypeptide
EIVLTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTKVEIK

SEQ ID NO: 985 - protein, 454 aa, Artificial Sequence; identical to SEQ ID NO: 373
  Description of Artificial Sequence: Synthetic polypeptide

SEQ ID NO: 986 - protein, 216 aa, Artificial Sequence
  Description of Artificial Sequence: Synthetic polypeptide
EIVLTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 987 - protein, 5 aa, Artificial Sequence
  Description of Artificial Sequence: Synthetic peptide
NYDMN

SEQ ID NO: 988 - protein, 17 aa, Artificial Sequence
  Description of Artificial Sequence: Synthetic peptide
SISSSSSYIYYADSVKG

SEQ ID NO: 989 - protein, 15 aa, Artificial Sequence
  Description of Artificial Sequence: Synthetic peptide
DVGVTTDYYYYGMDV

SEQ ID NO: 990 - protein, 12 aa, Artificial Sequence
  Description of Artificial Sequence: Synthetic peptide
RASQSVASSYLA

SEQ ID NO: 991 - protein, 7 aa, Artificial Sequence
  Description of Artificial Sequence: Synthetic peptide
GASSRAT

SEQ ID NO: 992 - protein, 10 aa, Artificial Sequence
  Description of Artificial Sequence: Synthetic peptide
QQYGSSPPYT

SEQ ID NO: 993 - protein, 7 aa, Artificial Sequence
  Description of Artificial Sequence: Synthetic peptide
GFTFSNY

SEQ ID NO: 994 - protein, 6 aa, Artificial Sequence
  Description of Artificial Sequence: Synthetic peptide
SSSSSY

SEQ ID NO: 995 - protein, 14 aa, Artificial Sequence
  Description of Artificial Sequence: Synthetic peptide
DVGVTTDYYYYGMD

SEQ ID NO: 996 - protein, 8 aa, Artificial Sequence
  Description of Artificial Sequence: Synthetic peptide
SQSVASSY

SEQ ID NO: 997 - protein, 3 aa, Artificial Sequence
  Description of Artificial Sequence: Synthetic peptide
GAS

SEQ ID NO: 998 - protein, 7 aa, Artificial Sequence
  Description of Artificial Sequence: Synthetic peptide
YGSSPPY

SEQ ID NO: 999 - protein, 10 aa, Artificial Sequence
  Description of Artificial Sequence: Synthetic peptide
GFTFSNYDMN

SEQ ID NO: 1000 - protein, 10 aa, Artificial Sequence
  Description of Artificial Sequence: Synthetic peptide
SISSSSSYIY

SEQ ID NO: 1001 - protein, 15 aa, Artificial Sequence
  Description of Artificial Sequence: Synthetic peptide
DVGVTTDYYYYGMDV

SEQ ID NO: 1002 - protein, 12 aa, Artificial Sequence
  Description of Artificial Sequence: Synthetic peptide
RASQSVASSYLA

SEQ ID NO: 1003 - protein, 7 aa, Artificial Sequence
  Description of Artificial Sequence: Synthetic peptide
GASSRAT

SEQ ID NO: 1004 - protein, 10 aa, Artificial Sequence
  Description of Artificial Sequence: Synthetic peptide
QQYGSSPPYT

SEQ ID NO: 1005 - protein, 6 aa, Artificial Sequence
  Description of Artificial Sequence: Synthetic peptide
SNYDMN

SEQ ID NO: 1006 - protein, 13 aa, Artificial Sequence
  Description of Artificial Sequence: Synthetic peptide
WVSSISSSSSYIY

SEQ ID NO: 1007 - protein, 16 aa, Artificial Sequence
  Description of Artificial Sequence: Synthetic peptide
ARDVGVTTDYYYYGMD

SEQ ID NO: 1008 - protein, 8 aa, Artificial Sequence
  Description of Artificial Sequence: Synthetic peptide
ASSYLAWY

SEQ ID NO: 1009 - protein, 10 aa, Artificial Sequence
  Description of Artificial Sequence: Synthetic peptide
LLIYGASSRA

SEQ ID NO: 1010 - protein, 9 aa, Artificial Sequence
  Description of Artificial Sequence: Synthetic peptide
QQYGSSPPY

SEQ ID NO: 1011 - protein, 8 aa, Artificial Sequence
  Description of Artificial Sequence: Synthetic peptide
GFTFSNYD

SEQ ID NO: 1012 - protein, 8 aa, Artificial Sequence
  Description of Artificial Sequence: Synthetic peptide
ISSSSSYI

SEQ ID NO: 1013 - protein, 17 aa, Artificial Sequence
  Description of Artificial Sequence: Synthetic peptide
ARDVGVTTDYYYYGMDV

SEQ ID NO: 1014 - protein, 7 aa, Artificial Sequence
  Description of Artificial Sequence: Synthetic peptide
QSVASSY

SEQ ID NO: 1015 - protein, 3 aa, Artificial Sequence
  Description of Artificial Sequence: Synthetic peptide
GAS

SEQ ID NO: 1016 - protein, 10 aa, Artificial Sequence
  Description of Artificial Sequence: Synthetic peptide
QQYGSSPPYT

SEQ ID NO: 1017 - protein, 124 aa, Artificial Sequence
  Description of Artificial Sequence: Synthetic polypeptide
EVQLLESGGGLVKPGGSLRLSCSASGFTFSNYDMNWVRQAPGKGLEWVSSISSSSSYIYYADSVKGRFTISRDNAKNSLYLQMNSLRAEDTAVYHCARDVGVTTDYYYYGMDVWGQGTMVTVSS

SEQ ID NO: 1018 - protein, 109 aa, Artificial Sequence; identical to SEQ ID NO: 304
  Description of Artificial Sequence: Synthetic polypeptide

SEQ ID NO: 1019 - protein, 454 aa, Artificial Sequence
  Description of Artificial Sequence: Synthetic polypeptide
EVQLLESGGGLVKPGGSLRLSCSASGFTFSNYDMNWVRQAPGKGLEWVSSISSSSSYIYYADSVKGRFTISRDNAKNSLYLQMNSLRAEDTAVYHCARDVGVTTDYYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1020 - protein, 216 aa, Artificial Sequence; identical to SEQ ID NO: 306
  Description of Artificial Sequence: Synthetic polypeptide

SEQ ID NO: 1021 - protein, 5 aa, Artificial Sequence
  Description of Artificial Sequence: Synthetic peptide
TYGMN

SEQ ID NO: 1022 - protein, 17 aa, Artificial Sequence
  Description of Artificial Sequence: Synthetic peptide
YISTSSYTIYYSDSVKG

SEQ ID NO: 1023 - protein, 9 aa, Artificial Sequence
  Description of Artificial Sequence: Synthetic peptide
EGDWWYFDL

SEQ ID NO: 1024 - protein, 14 aa, Artificial Sequence
  Description of Artificial Sequence: Synthetic peptide
TGTSSDVGGYNYVS

SEQ ID NO: 1025 - protein, 7 aa, Artificial Sequence
  Description of Artificial Sequence: Synthetic peptide
EVSNRPS

SEQ ID NO: 1026 - protein, 10 aa, Artificial Sequence
  Description of Artificial Sequence: Synthetic peptide
SSYTSSSTLV

SEQ ID NO: 1027 - protein, 7 aa, Artificial Sequence
  Description of Artificial Sequence: Synthetic peptide
GFTFSTY

SEQ ID NO: 1028 - protein, 6 aa, Artificial Sequence
  Description of Artificial Sequence: Synthetic peptide
STSSYT

SEQ ID NO: 1029 - protein, 8 aa, Artificial Sequence
  Description of Artificial Sequence: Synthetic peptide
EGDWWYFD

SEQ ID NO: 1030 - protein, 10 aa, Artificial Sequence
  Description of Artificial Sequence: Synthetic peptide
TSSDVGGYNY

SEQ ID NO: 1031 - protein, 3 aa, Artificial Sequence
  Description of Artificial Sequence: Synthetic peptide
EVS

SEQ ID NO: 1032 - protein, 7 aa, Artificial Sequence
  Description of Artificial Sequence: Synthetic peptide
YTSSSTL

SEQ ID NO: 1033 - protein, 10 aa, Artificial Sequence
  Description of Artificial Sequence: Synthetic peptide
GFTFSTYGMN

SEQ ID NO: 1034 - protein, 10 aa, Artificial Sequence
  Description of Artificial Sequence: Synthetic peptide
YISTSSYTIY

SEQ ID NO: 1035 - protein, 9 aa, Artificial Sequence
  Description of Artificial Sequence: Synthetic peptide
EGDWWYFDL

SEQ ID NO: 1036 - protein, 14 aa, Artificial Sequence
  Description of Artificial Sequence: Synthetic peptide
TGTSSDVGGYNYVS

SEQ ID NO: 1037 - protein, 7 aa, Artificial Sequence
  Description of Artificial Sequence: Synthetic peptide
EVSNRPS

SEQ ID NO: 1038 - protein, 10 aa, Artificial Sequence
  Description of Artificial Sequence: Synthetic peptide
SSYTSSSTLV

SEQ ID NO: 1039 - protein, 6 aa, Artificial Sequence
  Description of Artificial Sequence: Synthetic peptide
STYGMN

SEQ ID NO: 1040 - protein, 13 aa, Artificial Sequence
  Description of Artificial Sequence: Synthetic peptide
WISYISTSSYTIY

SEQ ID NO: 1041 - protein, 10 aa, Artificial Sequence
  Description of Artificial Sequence: Synthetic peptide
AREGDWWYFD

SEQ ID NO: 1042 - protein, 10 aa, Artificial Sequence
  Description of Artificial Sequence: Synthetic peptide
VGGYNYVSWY

SEQ ID NO: 1043 - protein, 10 aa, Artificial Sequence
  Description of Artificial Sequence: Synthetic peptide
LMIYEVSNRP

SEQ ID NO: 1044 - protein, 9 aa, Artificial Sequence
  Description of Artificial Sequence: Synthetic peptide
SSYTSSSTL

SEQ ID NO: 1045 - protein, 8 aa, Artificial Sequence
  Description of Artificial Sequence: Synthetic peptide
GFTFSTYG

SEQ ID NO: 1046 - protein, 8 aa, Artificial Sequence
  Description of Artificial Sequence: Synthetic peptide
ISTSSYTI

SEQ ID NO: 1047 - protein, 11 aa, Artificial Sequence
  Description of Artificial Sequence: Synthetic peptide
AREGDWWYFDL

SEQ ID NO: 1048 - protein, 9 aa, Artificial Sequence
  Description of Artificial Sequence: Synthetic peptide
SSDVGGYNY

SEQ ID NO: 1049 - protein, 3 aa, Artificial Sequence
  Description of Artificial Sequence: Synthetic peptide
EVS

SEQ ID NO: 1050 - protein, 10 aa, Artificial Sequence
  Description of Artificial Sequence: Synthetic peptide
SSYTSSSTLV

SEQ ID NO: 1051 - protein, 118 aa, Artificial Sequence
  Description of Artificial Sequence: Synthetic polypeptide
EVQLVESGGGLVQPGGSLRLSCAASGFTFSTYGMNWVRQAPGKGLEWISYISTSSYTIYYSDSVKGRFTVSRDNAKNSLYLQMNSLRDEDTAVYYCAREGDWWYFDLWGRGTTVTVSS

SEQ ID NO: 1052 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSYRFSGSKSGNTASLTISGLQAEDEADYYCSSYTSSSTLVFGGGTKLTVL

SEQ ID NO: 1053 - protein, 448 aa, Artificial Sequence
  Description of Artificial Sequence: Synthetic polypeptide
EVQLVESGGGLVQPGGSLRLSCAASGFTFSTYGMNWVRQAPGKGLEWISYISTSSYTIYYSDSVKGRFTVSRDNAKNSLYLQMNSLRDEDTAVYYCAREGDWWYFDLWGRGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1054 - protein, 216 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSYRFSGSKSGNTASLTISGLQAEDEADYYCSSYTSSSTLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1055 - protein, 5 aa, Artificial Sequence
  Description of Artificial Sequence: Synthetic peptide
NYDMN

SEQ ID NO: 1056 - protein, 17 aa, Artificial Sequence
  Description of Artificial Sequence: Synthetic peptide
SISSSSSYIYYADSVKG

SEQ ID NO: 1057 - protein, 15 aa, Artificial Sequence
  Description of Artificial Sequence: Synthetic peptide
DVGVTTDYYYYGMDV

SEQ ID NO: 1058 - protein, 12 aa, Artificial Sequence
  Description of Artificial Sequence: Synthetic peptide
RASQSVASSYLA

SEQ ID NO: 1059 - protein, 7 aa, Artificial Sequence
  Description of Artificial Sequence: Synthetic peptide
GASSRAT

SEQ ID NO: 1060 - protein, 10 aa, Artificial Sequence
  Description of Artificial Sequence: Synthetic peptide
QQYGSSPPYT

SEQ ID NO: 1061 - protein, 7 aa, Artificial Sequence
  Description of Artificial Sequence: Synthetic peptide
GFTFSNY

SEQ ID NO: 1062 - protein, 6 aa, Artificial Sequence
  Description of Artificial Sequence: Synthetic peptide
SSSSSY

SEQ ID NO: 1063 - protein, 14 aa, Artificial Sequence
  Description of Artificial Sequence: Synthetic peptide
DVGVTTDYYYYGMD

SEQ ID NO: 1064 - protein, 8 aa, Artificial Sequence
  Description of Artificial Sequence: Synthetic peptide
SQSVASSY

SEQ ID NO: 1065 - protein, 3 aa, Artificial Sequence
  Description of Artificial Sequence: Synthetic peptide
GAS

SEQ ID NO: 1066 - protein, 7 aa, Artificial Sequence
  Description of Artificial Sequence: Synthetic peptide
YGSSPPY

SEQ ID NO: 1067 - protein, 10 aa, Artificial Sequence
  Description of Artificial Sequence: Synthetic peptide
GFTFSNYDMN

SEQ ID NO: 1068 - protein, 10 aa, Artificial Sequence
  Description of Artificial Sequence: Synthetic peptide
SISSSSSYIY

SEQ ID NO: 1069 - protein, 15 aa, Artificial Sequence
  Description of Artificial Sequence: Synthetic peptide
DVGVTTDYYYYGMDV

SEQ ID NO: 1070 - protein, 12 aa, Artificial Sequence
  Description of Artificial Sequence: Synthetic peptide
RASQSVASSYLA

SEQ ID NO: 1071 - protein, 7 aa, Artificial Sequence
  Description of Artificial Sequence: Synthetic peptide
GASSRAT

SEQ ID NO: 1072 - protein, 10 aa, Artificial Sequence
  Description of Artificial Sequence: Synthetic peptide
QQYGSSPPYT

SEQ ID NO: 1073 - protein, 6 aa, Artificial Sequence
  Description of Artificial Sequence: Synthetic peptide
SNYDMN

SEQ ID NO: 1074 - protein, 13 aa, Artificial Sequence
  Description of Artificial Sequence: Synthetic peptide
WVSSISSSSSYIY

SEQ ID NO: 1075 - protein, 16 aa, Artificial Sequence
  Description of Artificial Sequence: Synthetic peptide
ARDVGVTTDYYYYGMD

SEQ ID NO: 1076 - protein, 8 aa, Artificial Sequence
  Description of Artificial Sequence: Synthetic peptide
ASSYLAWY

SEQ ID NO: 1077 - protein, 10 aa, Artificial Sequence
  Description of Artificial Sequence: Synthetic peptide
LLIYGASSRA

SEQ ID NO: 1078 - protein, 9 aa, Artificial Sequence
  Description of Artificial Sequence: Synthetic peptide
QQYGSSPPY

SEQ ID NO: 1079 - protein, 8 aa, Artificial Sequence
  Description of Artificial Sequence: Synthetic peptide
GFTFSNYD

SEQ ID NO: 1080 - protein, 8 aa, Artificial Sequence
  Description of Artificial Sequence: Synthetic peptide
ISSSSSYI

SEQ ID NO: 1081 - protein, 17 aa, Artificial Sequence
  Description of Artificial Sequence: Synthetic peptide
ARDVGVTTDYYYYGMDV

SEQ ID NO: 1082 - protein, 7 aa, Artificial Sequence
  Description of Artificial Sequence: Synthetic peptide
QSVASSY

SEQ ID NO: 1083 - protein, 3 aa, Artificial Sequence
  Description of Artificial Sequence: Synthetic peptide
GAS

SEQ ID NO: 1084 - protein, 10 aa, Artificial Sequence
  Description of Artificial Sequence: Synthetic peptide
QQYGSSPPYT

SEQ ID NO: 1085 - protein, 124 aa, Artificial Sequence; identical to SEQ ID NO: 303
  Description of Artificial Sequence: Synthetic polypeptide

SEQ ID NO: 1086 - protein, 109 aa, Artificial Sequence; identical to SEQ ID NO: 372
  Description of Artificial Sequence: Synthetic polypeptide

SEQ ID NO: 1087 - protein, 454 aa, Artificial Sequence; identical to SEQ ID NO: 305
  Description of Artificial Sequence: Synthetic polypeptide

SEQ ID NO: 1088 - protein, 216 aa, Artificial Sequence; identical to SEQ ID NO: 374
  Description of Artificial Sequence: Synthetic polypeptide

SEQ ID NO: 1089 - protein, 5 aa, Artificial Sequence
  Description of Artificial Sequence: Synthetic peptide
HYDMN

SEQ ID NO: 1090 - protein, 17 aa, Artificial Sequence
  Description of Artificial Sequence: Synthetic peptide
SISSSSSYIFYADSVKG

SEQ ID NO: 1091 - protein, 17 aa, Artificial Sequence
  Description of Artificial Sequence: Synthetic peptide
DRGVGDTSDYYSFGLDV

SEQ ID NO: 1092 - protein, 11 aa, Artificial Sequence
  Description of Artificial Sequence: Synthetic peptide
RASQGIATYLA

SEQ ID NO: 1093 - protein, 7 aa, Artificial Sequence
  Description of Artificial Sequence: Synthetic peptide
AASTLQS

SEQ ID NO: 1094 - protein, 10 aa, Artificial Sequence
  Description of Artificial Sequence: Synthetic peptide
QKYNSAPPWT

SEQ ID NO: 1095 - protein, 7 aa, Artificial Sequence
  Description of Artificial Sequence: Synthetic peptide
GFTFSHY

SEQ ID NO: 1096 - protein, 6 aa, Artificial Sequence
  Description of Artificial Sequence: Synthetic peptide
SSSSSY

SEQ ID NO: 1097 - protein, 16 aa, Artificial Sequence
  Description of Artificial Sequence: Synthetic peptide
DRGVGDTSDYYSFGLD

SEQ ID NO: 1098 - protein, 7 aa, Artificial Sequence
  Description of Artificial Sequence: Synthetic peptide
SQGIATY

SEQ ID NO: 1099 - protein, 3 aa, Artificial Sequence
  Description of Artificial Sequence: Synthetic peptide
AAS

SEQ ID NO: 1100 - protein, 7 aa, Artificial Sequence
  Description of Artificial Sequence: Synthetic peptide
YNSAPPW

SEQ ID NO: 1101 - protein, 10 aa, Artificial Sequence
  Description of Artificial Sequence: Synthetic peptide
GFTFSHYDMN

SEQ ID NO: 1102 - protein, 10 aa, Artificial Sequence
  Description of Artificial Sequence: Synthetic peptide
SISSSSSYIF

SEQ ID NO: 1103 - protein, 17 aa, Artificial Sequence
  Description of Artificial Sequence: Synthetic peptide
DRGVGDTSDYYSFGLDV

SEQ ID NO: 1104 - protein, 11 aa, Artificial Sequence
  Description of Artificial Sequence: Synthetic peptide
RASQGIATYLA

SEQ ID NO: 1105 - protein, 7 aa, Artificial Sequence
  Description of Artificial Sequence: Synthetic peptide
AASTLQS

SEQ ID NO: 1106 - protein, 10 aa, Artificial Sequence
  Description of Artificial Sequence: Synthetic peptide
QKYNSAPPWT

SEQ ID NO: 1107 - protein, 6 aa, Artificial Sequence
  Description of Artificial Sequence: Synthetic peptide
SHYDMN

SEQ ID NO: 1108 - protein, 13 aa, Artificial Sequence
  Description of Artificial Sequence: Synthetic peptide
WVSSISSSSSYIF

SEQ ID NO: 1109 - protein, 18 aa, Artificial Sequence
  Description of Artificial Sequence: Synthetic peptide
ARDRGVGDTSDYYSFGLD

SEQ ID NO: 1110 - protein, 7 aa, Artificial Sequence
  Description of Artificial Sequence: Synthetic peptide
ATYLAWY

SEQ ID NO: 1111 - protein, 10 aa, Artificial Sequence
  Description of Artificial Sequence: Synthetic peptide
LLIYAASTLQ

SEQ ID NO: 1112 - protein, 9 aa, Artificial Sequence
  Description of Artificial Sequence: Synthetic peptide
QKYNSAPPW

SEQ ID NO: 1113 - protein, 8 aa, Artificial Sequence
  Description of Artificial Sequence: Synthetic peptide
GFTFSHYD

SEQ ID NO: 1114 - protein, 8 aa, Artificial Sequence
  Description of Artificial Sequence: Synthetic peptide
ISSSSSYI

SEQ ID NO: 1115 - protein, 19 aa, Artificial Sequence
  Description of Artificial Sequence: Synthetic peptide
ARDRGVGDTSDYYSFGLDV

SEQ ID NO: 1116 - protein, 6 aa, Artificial Sequence
  Description of Artificial Sequence: Synthetic peptide
QGIATY

SEQ ID NO: 1117 - protein, 3 aa, Artificial Sequence
  Description of Artificial Sequence: Synthetic peptide
AAS

SEQ ID NO: 1118 - protein, 10 aa, Artificial Sequence
  Description of Artificial Sequence: Synthetic peptide
QKYNSAPPWT

SEQ ID NO: 1119 - protein, 126 aa, Artificial Sequence
  Description of Artificial Sequence: Synthetic polypeptide
QVQLVESGGGLVKPGGSLRLSCAASGFTFSHYDMNWVRQAPGKGLEWVSSISSSSSYIFYADSVKGRFTISRDNAKNSLLLQMNSLRAEDTAVYHCARDRGVGDTSDYYSFGLDVWGQGTTVTVSS

SEQ ID NO: 1120 - protein, 108 aa, Artificial Sequence
  Description of Artificial Sequence: Synthetic polypeptide
EIVLTQSPSSLSASVGDRVTITCRASQGIATYLAWYQQKPGKVPNLLIYAASTLQSGVPSRFSGSGSGTDFTLTISSLQPEDVATYYCQKYNSAPPWTFGQGTKVEIK

SEQ ID NO: 1121 - protein, 456 aa, Artificial Sequence
  Description of Artificial Sequence: Synthetic polypeptide
QVQLVESGGGLVKPGGSLRLSCAASGFTFSHYDMNWVRQAPGKGLEWVSSISSSSSYIFYADSVKGRFTISRDNAKNSLLLQMNSLRAEDTAVYHCARDRGVGDTSDYYSFGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1122 - protein, 215 aa, Artificial Sequence
  Description of Artificial Sequence: Synthetic polypeptide
EIVLTQSPSSLSASVGDRVTITCRASQGIATYLAWYQQKPGKVPNLLIYAASTLQSGVPSRFSGSGSGTDFTLTISSLQPEDVATYYCQKYNSAPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1123 - protein, 5 aa, Artificial Sequence
  Description of Artificial Sequence: Synthetic peptide
NYGMN

SEQ ID NO: 1124 - protein, 17 aa, Artificial Sequence
  Description of Artificial Sequence: Synthetic peptide
YISSGSSYKYYADSMKG

SEQ ID NO: 1125 - protein, 14 aa, Artificial Sequence
  Description of Artificial Sequence: Synthetic peptide
DPVVTEYYYYGMDV

SEQ ID NO: 1126 - protein, 11 aa, Artificial Sequence
  Description of Artificial Sequence: Synthetic peptide
RASQGINSWLA

SEQ ID NO: 1127 - protein, 7 aa, Artificial Sequence
  Description of Artificial Sequence: Synthetic peptide
AASSLQS

SEQ ID NO: 1128 - protein, 9 aa, Artificial Sequence
  Description of Artificial Sequence: Synthetic peptide
QQANSFPWT

SEQ ID NO: 1129 - protein, 7 aa, Artificial Sequence
  Description of Artificial Sequence: Synthetic peptide
GFTFSNY

SEQ ID NO: 1130 - protein, 6 aa, Artificial Sequence
  Description of Artificial Sequence: Synthetic peptide
SSGSSY

SEQ ID NO: 1131 - protein, 13 aa, Artificial Sequence
  Description of Artificial Sequence: Synthetic peptide
DPVVTEYYYYGMD

SEQ ID NO: 1132 - protein, 7 aa, Artificial Sequence
  Description of Artificial Sequence: Synthetic peptide
SQGINSW

SEQ ID NO: 1133 - protein, 3 aa, Artificial Sequence
  Description of Artificial Sequence: Synthetic peptide
AAS

SEQ ID NO: 1134 - protein, 6 aa, Artificial Sequence
  Description of Artificial Sequence: Synthetic peptide
ANSFPW

SEQ ID NO: 1135 - protein, 10 aa, Artificial Sequence
  Description of Artificial Sequence: Synthetic peptide
GFTFSNYGMN

SEQ ID NO: 1136 - protein, 10 aa, Artificial Sequence
  Description of Artificial Sequence: Synthetic peptide
YISSGSSYKY

SEQ ID NO: 1137 - protein, 14 aa, Artificial Sequence
  Description of Artificial Sequence: Synthetic peptide
DPVVTEYYYYGMDV

SEQ ID NO: 1138 - protein, 11 aa, Artificial Sequence
  Description of Artificial Sequence: Synthetic peptide
RASQGINSWLA

SEQ ID NO: 1139 - protein, 7 aa, Artificial Sequence
  Description of Artificial Sequence: Synthetic peptide
AASSLQS

SEQ ID NO: 1140 - protein, 9 aa, Artificial Sequence
  Description of Artificial Sequence: Synthetic peptide
QQANSFPWT

SEQ ID NO: 1141 - protein, 6 aa, Artificial Sequence
  Description of Artificial Sequence: Synthetic peptide
SNYGMN

SEQ ID NO: 1142 - protein, 13 aa, Artificial Sequence
  Description of Artificial Sequence: Synthetic peptide
WVSYISSGSSYKY

SEQ ID NO: 1143 - protein, 15 aa, Artificial Sequence
  Description of Artificial Sequence: Synthetic peptide
ARDPVVTEYYYYGMD

SEQ ID NO: 1144 - protein, 7 aa, Artificial Sequence
  Description of Artificial Sequence: Synthetic peptide
NSWLAWY

SEQ ID NO: 1145 - protein, 10 aa, Artificial Sequence
  Description of Artificial Sequence: Synthetic peptide
LLIYAASSLQ

SEQ ID NO: 1146 - protein, 8 aa, Artificial Sequence
  Description of Artificial Sequence: Synthetic peptide
QQANSFPW

SEQ ID NO: 1147 - protein, 8 aa, Artificial Sequence
  Description of Artificial Sequence: Synthetic peptide
GFTFSNYG

SEQ ID NO: 1148 - protein, 8 aa, Artificial Sequence
  Description of Artificial Sequence: Synthetic peptide
ISSGSSYK

SEQ ID NO: 1149 - protein, 16 aa, Artificial Sequence
  Description of Artificial Sequence: Synthetic peptide
ARDPVVTEYYYYGMDV

SEQ ID NO: 1150 - protein, 6 aa, Artificial Sequence
  Description of Artificial Sequence: Synthetic peptide
QGINSW

SEQ ID NO: 1151 - protein, 3 aa, Artificial Sequence
  Description of Artificial Sequence: Synthetic peptide
AAS

SEQ ID NO: 1152 - protein, 9 aa, Artificial Sequence
  Description of Artificial Sequence: Synthetic peptide
QQANSFPWT

SEQ ID NO: 1153 - protein, 123 aa, Artificial Sequence; identical to SEQ ID NO: 609
  Description of Artificial Sequence: Synthetic polypeptide

SEQ ID NO: 1154 - protein, 107 aa, Artificial Sequence; identical to SEQ ID NO: 100
  Description of Artificial Sequence: Synthetic polypeptide

SEQ ID NO: 1155 - protein, 453 aa, Artificial Sequence; identical to SEQ ID NO: 611
  Description of Artificial Sequence: Synthetic polypeptide

SEQ ID NO: 1156 - protein, 214 aa, Artificial Sequence; identical to SEQ ID NO: 102
  Description of Artificial Sequence: Synthetic polypeptide

SEQ ID NO: 1157 - protein, 5 aa, Artificial Sequence
  Description of Artificial Sequence: Synthetic peptide
SYTMN

SEQ ID NO: 1158 - protein, 17 aa, Artificial Sequence
  Description of Artificial Sequence: Synthetic peptide
SISTSSSYIDYADSVKG

SEQ ID NO: 1159 - protein, 14 aa, Artificial Sequence
  Description of Artificial Sequence: Synthetic peptide
DGDMVAPIKGSFDY

SEQ ID NO: 1160 - protein, 17 aa, Artificial Sequence
  Description of Artificial Sequence: Synthetic peptide
RSSQSLLNSDDGNTYLD

SEQ ID NO: 1161 - protein, 7 aa, Artificial Sequence
  Description of Artificial Sequence: Synthetic peptide
TLSYRAS

SEQ ID NO: 1162 - protein, 9 aa, Artificial Sequence
  Description of Artificial Sequence: Synthetic peptide
MQRIEFPIT

SEQ ID NO: 1163 - protein, 7 aa, Artificial Sequence
  Description of Artificial Sequence: Synthetic peptide
GFTFSSY

SEQ ID NO: 1164 - protein, 6 aa, Artificial Sequence
  Description of Artificial Sequence: Synthetic peptide
STSSSY

SEQ ID NO: 1165 - protein, 13 aa, Artificial Sequence
  Description of Artificial Sequence: Synthetic peptide
DGDMVAPIKGSFD

SEQ ID NO: 1166 - protein, 13 aa, Artificial Sequence
  Description of Artificial Sequence: Synthetic peptide
SQSLLNSDDGNTY

SEQ ID NO: 1167 - protein, 3 aa, Artificial Sequence
  Description of Artificial Sequence: Synthetic peptide
TLS

SEQ ID NO: 1168 - protein, 6 aa, Artificial Sequence
  Description of Artificial Sequence: Synthetic peptide
RIEFPI

SEQ ID NO: 1169 - protein, 10 aa, Artificial Sequence
  Description of Artificial Sequence: Synthetic peptide
GFTFSSYTMN

SEQ ID NO: 1170 - protein, 10 aa, Artificial Sequence
  Description of Artificial Sequence: Synthetic peptide
SISTSSSYID

SEQ ID NO: 1171 - protein, 14 aa, Artificial Sequence
  Description of Artificial Sequence: Synthetic peptide
DGDMVAPIKGSFDY

SEQ ID NO: 1172 - protein, 17 aa, Artificial Sequence
  Description of Artificial Sequence: Synthetic peptide
RSSQSLLNSDDGNTYLD

SEQ ID NO: 1173 - protein, 7 aa, Artificial Sequence
  Description of Artificial Sequence: Synthetic peptide
TLSYRAS

SEQ ID NO: 1174 - protein, 9 aa, Artificial Sequence
  Description of Artificial Sequence: Synthetic peptide
MQRIEFPIT

SEQ ID NO: 1175 - protein, 6 aa, Artificial Sequence
  Description of Artificial Sequence: Synthetic peptide
SSYTMN

SEQ ID NO: 1176 - protein, 13 aa, Artificial Sequence
  Description of Artificial Sequence: Synthetic peptide
WVSSISTSSSYID

SEQ ID NO: 1177 - protein, 15 aa, Artificial Sequence
  Description of Artificial Sequence: Synthetic peptide
ARDGDMVAPIKGSFD

SEQ ID NO: 1178 - protein, 13 aa, Artificial Sequence
  Description of Artificial Sequence: Synthetic peptide
LNSDDGNTYLDWY

SEQ ID NO: 1179 - protein, 10 aa, Artificial Sequence
  Description of Artificial Sequence: Synthetic peptide
LLIYTLSYRA

SEQ ID NO: 1180 - protein, 8 aa, Artificial Sequence
  Description of Artificial Sequence: Synthetic peptide
MQRIEFPI

SEQ ID NO: 1181 - protein, 8 aa, Artificial Sequence
  Description of Artificial Sequence: Synthetic peptide
GFTFSSYT

SEQ ID NO: 1182 - protein, 8 aa, Artificial Sequence
  Description of Artificial Sequence: Synthetic peptide
ISTSSSYI

SEQ ID NO: 1183 - protein, 16 aa, Artificial Sequence
  Description of Artificial Sequence: Synthetic peptide
ARDGDMVAPIKGSFDY

SEQ ID NO: 1184 - protein, 12 aa, Artificial Sequence
  Description of Artificial Sequence: Synthetic peptide
QSLLNSDDGNTY

SEQ ID NO: 1185 - protein, 3 aa, Artificial Sequence
  Description of Artificial Sequence: Synthetic peptide
TLS

SEQ ID NO: 1186 - protein, 9 aa, Artificial Sequence
  Description of Artificial Sequence: Synthetic peptide
MQRIEFPIT

SEQ ID NO: 1187 - protein, 123 aa, Artificial Sequence
  Description of Artificial Sequence: Synthetic polypeptide
EVQLVESGGGLVKPGGSLRLSCAVSGFTFSSYTMNWVRQAPGKGLEWVSSISTSSSYIDYADSVKGRFTISRDNAKKSLYLQMNSLRAEDTAVYYCARDGDMVAPIKGSFDYWGQGTLVTVSS

SEQ ID NO: 1188 - protein, 113 aa, Artificial Sequence
  Description of Artificial Sequence: Synthetic polypeptide
EIVLTQSPLSLPVTPGEPASISCRSSQSLLNSDDGNTYLDWYLQKPGQSPQLLIYTLSYRASGVPDRFSGSGSGTDFTLKISRVEAEDVGVYYCMQRIEFPITFGQGTRLEIK

SEQ ID NO: 1189 - protein, 453 aa, Artificial Sequence
  Description of Artificial Sequence: Synthetic polypeptide
EVQLVESGGGLVKPGGSLRLSCAVSGFTFSSYTMNWVRQAPGKGLEWVSSISTSSSYIDYADSVKGRFTISRDNAKKSLYLQMNSLRAEDTAVYYCARDGDMVAPIKGSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1190 - protein, 220 aa, Artificial Sequence
  Description of Artificial Sequence: Synthetic polypeptide
EIVLTQSPLSLPVTPGEPASISCRSSQSLLNSDDGNTYLDWYLQKPGQSPQLLIYTLSYRASGVPDRFSGSGSGTDFTLKISRVEAEDVGVYYCMQRIEFPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1191 - protein, 7 aa, Artificial Sequence
  Description of Artificial Sequence: Synthetic peptide
SSGMCVS

SEQ ID NO: 1192 - protein, 16 aa, Artificial Sequence
  Description of Artificial Sequence: Synthetic peptide
LIDWFDDKYYSTSLKT

SEQ ID NO: 1193 - protein, 13 aa, Artificial Sequence
  Description of Artificial Sequence: Synthetic peptide
IRGTGAYYYGLDV

SEQ ID NO: 1194 - protein, 11 aa, Artificial Sequence
  Description of Artificial Sequence: Synthetic peptide
SGNELGDKYAS

SEQ ID NO: 1195 - protein, 7 aa, Artificial Sequence
  Description of Artificial Sequence: Synthetic peptide
QDNKRPS

SEQ ID NO: 1196 - protein, 9 aa, Artificial Sequence
  Description of Artificial Sequence: Synthetic peptide
QAWDSSKVV

SEQ ID NO: 1197 - protein, 9 aa, Artificial Sequence
  Description of Artificial Sequence: Synthetic peptide
GFSLSSSGM

SEQ ID NO: 1198 - protein, 5 aa, Artificial Sequence
  Description of Artificial Sequence: Synthetic peptide
DWFDD

SEQ ID NO: 1199 - protein, 12 aa, Artificial Sequence
  Description of Artificial Sequence: Synthetic peptide
IRGTGAYYYGLD

SEQ ID NO: 1200 - protein, 7 aa, Artificial Sequence
  Description of Artificial Sequence: Synthetic peptide
NELGDKY

SEQ ID NO: 1201 - protein, 3 aa, Artificial Sequence
  Description of Artificial Sequence: Synthetic peptide
QDN

SEQ ID NO: 1202 - protein, 6 aa, Artificial Sequence
  Description of Artificial Sequence: Synthetic peptide
WDSSKV

SEQ ID NO: 1203 - protein, 12 aa, Artificial Sequence
  Description of Artificial Sequence: Synthetic peptide
GFSLSSSGMCVS

SEQ ID NO: 1204 - protein, 9 aa, Artificial Sequence
  Description of Artificial Sequence: Synthetic peptide
LIDWFDDKY

SEQ ID NO: 1205 - protein, 13 aa, Artificial Sequence
  Description of Artificial Sequence: Synthetic peptide
IRGTGAYYYGLDV

SEQ ID NO: 1206 - protein, 11 aa, Artificial Sequence
  Description of Artificial Sequence: Synthetic peptide
SGNELGDKYAS

SEQ ID NO: 1207 - protein, 7 aa, Artificial Sequence
  Description of Artificial Sequence: Synthetic peptide
QDNKRPS

SEQ ID NO: 1208 - protein, 9 aa, Artificial Sequence
  Description of Artificial Sequence: Synthetic peptide
QAWDSSKVV

SEQ ID NO: 1209 - protein, 8 aa, Artificial Sequence
  Description of Artificial Sequence: Synthetic peptide
SSSGMCVS

SEQ ID NO: 1210 - protein, 12 aa, Artificial Sequence
  Description of Artificial Sequence: Synthetic peptide
WLTLIDWFDDKY

SEQ ID NO: 1211 - protein, 14 aa, Artificial Sequence
  Description of Artificial Sequence: Synthetic peptide
ARIRGTGAYYYGLD

SEQ ID NO: 1212 - protein, 7 aa, Artificial Sequence
  Description of Artificial Sequence: Synthetic peptide
DKYASWY

SEQ ID NO: 1213 - protein, 10 aa, Artificial Sequence
  Description of Artificial Sequence: Synthetic peptide
LVIYQDNKRP

SEQ ID NO: 1214 - protein, 8 aa, Artificial Sequence
  Description of Artificial Sequence: Synthetic peptide
QAWDSSKV

SEQ ID NO: 1215 - protein, 10 aa, Artificial Sequence
  Description of Artificial Sequence: Synthetic peptide
GFSLSSSGMC

SEQ ID NO: 1216 - protein, 7 aa, Artificial Sequence
  Description of Artificial Sequence: Synthetic peptide
IDWFDDK

SEQ ID NO: 1217 - protein, 15 aa, Artificial Sequence
  Description of Artificial Sequence: Synthetic peptide
ARIRGTGAYYYGLDV

SEQ ID NO: 1218 - protein, 6 aa, Artificial Sequence
  Description of Artificial Sequence: Synthetic peptide
ELGDKY

SEQ ID NO: 1219 - protein, 3 aa, Artificial Sequence
  Description of Artificial Sequence: Synthetic peptide
QDN

SEQ ID NO: 1220 - protein, 9 aa, Artificial Sequence
  Description of Artificial Sequence: Synthetic peptide
QAWDSSKVV

SEQ ID NO: 1221 - protein, 123 aa, Artificial Sequence
  Description of Artificial Sequence: Synthetic polypeptide
QVQLQESGPALVKPTQTLTLTCTFSGFSLSSSGMCVSWIRQPPGKALEWLTLIDWFDDKYYSTSLKTRLTISKDTSKNQVVLTMTNMDPVDTATYYCARIRGTGAYYYGLDVWGQGTMVTVSS

SEQ ID NO: 1222 - protein, 106 aa, Artificial Sequence
  Description of Artificial Sequence: Synthetic polypeptide
SYELMQPPSVSVSPGQTASITCSGNELGDKYASWYQQQPGQSPVLVIYQDNKRPSGIPERFSGSNSGNTATLTISGTQAMDEADYYCQAWDSSKVVFGGGTKLTVL

SEQ ID NO: 1223 - protein, 453 aa, Artificial Sequence
  Description of Artificial Sequence: Synthetic polypeptide
QVQLQESGPALVKPTQTLTLTCTFSGFSLSSSGMCVSWIRQPPGKALEWLTLIDWFDDKYYSTSLKTRLTISKDTSKNQVVLTMTNMDPVDTATYYCARIRGTGAYYYGLDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1224 - protein, 212 aa, Artificial Sequence
  Description of Artificial Sequence: Synthetic polypeptide
SYELMQPPSVSVSPGQTASITCSGNELGDKYASWYQQQPGQSPVLVIYQDNKRPSGIPERFSGSNSGNTATLTISGTQAMDEADYYCQAWDSSKVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1225 - protein, 5 aa, Artificial Sequence
  Description of Artificial Sequence: Synthetic peptide
NYDMN

SEQ ID NO: 1226 - protein, 17 aa, Artificial Sequence
  Description of Artificial Sequence: Synthetic peptide
SISSSSSYIYYADSVKG

SEQ ID NO: 1227 - protein, 15 aa, Artificial Sequence
  Description of Artificial Sequence: Synthetic peptide
DVGVTTDYYYYGMDV

SEQ ID NO: 1228 - protein, 12 aa, Artificial Sequence
  Description of Artificial Sequence: Synthetic peptide
RASQSVASSYLA

SEQ ID NO: 1229 - protein, 7 aa, Artificial Sequence
  Description of Artificial Sequence: Synthetic peptide
GASSRAT

SEQ ID NO: 1230 - protein, 10 aa, Artificial Sequence
  Description of Artificial Sequence: Synthetic peptide
QQYGSSPPYT

SEQ ID NO: 1231 - protein, 7 aa, Artificial Sequence
  Description of Artificial Sequence: Synthetic peptide
GFTFSNY

SEQ ID NO: 1232 - protein, 6 aa, Artificial Sequence
  Description of Artificial Sequence: Synthetic peptide
SSSSSY

SEQ ID NO: 1233 - protein, 14 aa, Artificial Sequence
  Description of Artificial Sequence: Synthetic peptide
DVGVTTDYYYYGMD

SEQ ID NO: 1234 - protein, 8 aa, Artificial Sequence
  Description of Artificial Sequence: Synthetic peptide
SQSVASSY

SEQ ID NO: 1235 - protein, 3 aa, Artificial Sequence
  Description of Artificial Sequence: Synthetic peptide
GAS

SEQ ID NO: 1236 - protein, 7 aa, Artificial Sequence
  Description of Artificial Sequence: Synthetic peptide
YGSSPPY

SEQ ID NO: 1237 - protein, 10 aa, Artificial Sequence
  Description of Artificial Sequence: Synthetic peptide
GFTFSNYDMN

SEQ ID NO: 1238 - protein, 10 aa, Artificial Sequence
  Description of Artificial Sequence: Synthetic peptide
SISSSSSYIY

SEQ ID NO: 1239 - protein, 15 aa, Artificial Sequence
  Description of Artificial Sequence: Synthetic peptide
DVGVTTDYYYYGMDV

SEQ ID NO: 1240 - protein, 12 aa, Artificial Sequence
  Description of Artificial Sequence: Synthetic peptide
RASQSVASSYLA

SEQ ID NO: 1241 - protein, 7 aa, Artificial Sequence
  Description of Artificial Sequence: Synthetic peptide
GASSRAT

SEQ ID NO: 1242 - protein, 10 aa, Artificial Sequence
  Description of Artificial Sequence: Synthetic peptide
QQYGSSPPYT

SEQ ID NO: 1243 - protein, 6 aa, Artificial Sequence
  Description of Artificial Sequence: Synthetic peptide
SNYDMN

SEQ ID NO: 1244 - protein, 13 aa, Artificial Sequence
  Description of Artificial Sequence: Synthetic peptide
WVSSISSSSSYIY

SEQ ID NO: 1245 - protein, 16 aa, Artificial Sequence
  Description of Artificial Sequence: Synthetic peptide
ARDVGVTTDYYYYGMD

SEQ ID NO: 1246 - protein, 8 aa, Artificial Sequence
  Description of Artificial Sequence: Synthetic peptide
ASSYLAWY

SEQ ID NO: 1247 - protein, 10 aa, Artificial Sequence
  Description of Artificial Sequence: Synthetic peptide
LLIYGASSRA

SEQ ID NO: 1248 - protein, 9 aa, Artificial Sequence
  Description of Artificial Sequence: Synthetic peptide
QQYGSSPPY

SEQ ID NO: 1249 - protein, 8 aa, Artificial Sequence
  Description of Artificial Sequence: Synthetic peptide
GFTFSNYD

SEQ ID NO: 1250 - protein, 8 aa, Artificial Sequence
  Description of Artificial Sequence: Synthetic peptide
ISSSSSYI

SEQ ID NO: 1251 - protein, 17 aa, Artificial Sequence
  Description of Artificial Sequence: Synthetic peptide
ARDVGVTTDYYYYGMDV

SEQ ID NO: 1252 - protein, 7 aa, Artificial Sequence
  Description of Artificial Sequence: Synthetic peptide
QSVASSY

SEQ ID NO: 1253 - protein, 3 aa, Artificial Sequence
  Description of Artificial Sequence: Synthetic peptide
GAS

SEQ ID NO: 1254 - protein, 10 aa, Artificial Sequence
  Description of Artificial Sequence: Synthetic peptide
QQYGSSPPYT

SEQ ID NO: 1255 - protein, 124 aa, Artificial Sequence; identical to SEQ ID NO: 201
  Description of Artificial Sequence: Synthetic polypeptide

SEQ ID NO: 1256 - protein, 109 aa, Artificial Sequence
  Description of Artificial Sequence: Synthetic polypeptide
EIVMTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTKVEIK

SEQ ID NO: 1257 - protein, 454 aa, Artificial Sequence; identical to SEQ ID NO: 203
  Description of Artificial Sequence: Synthetic polypeptide

SEQ ID NO: 1258 - protein, 216 aa, Artificial Sequence
  Description of Artificial Sequence: Synthetic polypeptide
EIVMTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1259 - protein, 5 aa, Artificial Sequence
  Description of Artificial Sequence: Synthetic peptide
SYGMY

SEQ ID NO: 1260 - protein, 17 aa, Artificial Sequence
  Description of Artificial Sequence: Synthetic peptide
SISTGSSYIYYADSVKG

SEQ ID NO: 1261 - protein, 13 aa, Artificial Sequence
  Description of Artificial Sequence: Synthetic peptide
DKGLAVTGYIMDV

SEQ ID NO: 1262 - protein, 11 aa, Artificial Sequence
  Description of Artificial Sequence: Synthetic peptide
QASQDISNYLN

SEQ ID NO: 1263 - protein, 7 aa, Artificial Sequence
  Description of Artificial Sequence: Synthetic peptide
DASNLET

SEQ ID NO: 1264 - protein, 10 aa, Artificial Sequence
  Description of Artificial Sequence: Synthetic peptide
QQYDNLPMYT

SEQ ID NO: 1265 - protein, 7 aa, Artificial Sequence
  Description of Artificial Sequence: Synthetic peptide
GFTFSSY

SEQ ID NO: 1266 - protein, 6 aa, Artificial Sequence
  Description of Artificial Sequence: Synthetic peptide
STGSSY

SEQ ID NO: 1267 - protein, 12 aa, Artificial Sequence
  Description of Artificial Sequence: Synthetic peptide
DKGLAVTGYIMD

SEQ ID NO: 1268 - protein, 7 aa, Artificial Sequence
  Description of Artificial Sequence: Synthetic peptide
SQDISNY

SEQ ID NO: 1269 - protein, 3 aa, Artificial Sequence
  Description of Artificial Sequence: Synthetic peptide
DAS

SEQ ID NO: 1270 - protein, 7 aa, Artificial Sequence
  Description of Artificial Sequence: Synthetic peptide
YDNLPMY

SEQ ID NO: 1271 - protein, 10 aa, Artificial Sequence
  Description of Artificial Sequence: Synthetic peptide
GFTFSSYGMY

SEQ ID NO: 1272 - protein, 10 aa, Artificial Sequence
  Description of Artificial Sequence: Synthetic peptide
SISTGSSYIY

SEQ ID NO: 1273 - protein, 13 aa, Artificial Sequence
  Description of Artificial Sequence: Synthetic peptide
DKGLAVTGYIMDV

SEQ ID NO: 1274 - protein, 11 aa, Artificial Sequence
  Description of Artificial Sequence: Synthetic peptide
QASQDISNYLN

SEQ ID NO: 1275 - protein, 7 aa, Artificial Sequence
  Description of Artificial Sequence: Synthetic peptide
DASNLET

SEQ ID NO: 1276 - protein, 10 aa, Artificial Sequence
  Description of Artificial Sequence: Synthetic peptide
QQYDNLPMYT

SEQ ID NO: 1277 - protein, 6 aa, Artificial Sequence
  Description of Artificial Sequence: Synthetic peptide
SSYGMY

SEQ ID NO: 1278 - protein, 13 aa, Artificial Sequence
  Description of Artificial Sequence: Synthetic peptide
WVSSISTGSSYIY

SEQ ID NO: 1279 - protein, 14 aa, Artificial Sequence
  Description of Artificial Sequence: Synthetic peptide
ARDKGLAVTGYIMD

SEQ ID NO: 1280 - protein, 7 aa, Artificial Sequence
  Description of Artificial Sequence: Synthetic peptide
SNYLNWY

SEQ ID NO: 1281 - protein, 10 aa, Artificial Sequence
  Description of Artificial Sequence: Synthetic peptide
LLIYDASNLE

SEQ ID NO: 1282 - protein, 9 aa, Artificial Sequence
  Description of Artificial Sequence: Synthetic peptide
QQYDNLPMY

SEQ ID NO: 1283 - protein, 8 aa, Artificial Sequence
  Description of Artificial Sequence: Synthetic peptide
GFTFSSYG

SEQ ID NO: 1284 - protein, 8 aa, Artificial Sequence
  Description of Artificial Sequence: Synthetic peptide
ISTGSSYI

SEQ ID NO: 1285 - protein, 15 aa, Artificial Sequence
  Description of Artificial Sequence: Synthetic peptide
ARDKGLAVTGYIMDV

SEQ ID NO: 1286 - protein, 6 aa, Artificial Sequence
  Description of Artificial Sequence: Synthetic peptide
QDISNY

SEQ ID NO: 1287 - protein, 3 aa, Artificial Sequence
  Description of Artificial Sequence: Synthetic peptide
DAS

SEQ ID NO: 1288 - protein, 10 aa, Artificial Sequence
  Description of Artificial Sequence: Synthetic peptide
QQYDNLPMYT

SEQ ID NO: 1289 - protein, 122 aa, Artificial Sequence
  Description of Artificial Sequence: Synthetic polypeptide
QVQLVESGGGLVKPGGSLRLSCASSGFTFSSYGMYWVRQAPGKGLEWVSSISTGSSYIYYADSVKGRFTISRDNAKNSLYLQMNSLRAEDTAVYYCARDKGLAVTGYIMDVWGQGTTVTVSS

SEQ ID NO: 1290 - protein, 108 aa, Artificial Sequence
  Description of Artificial Sequence: Synthetic polypeptide
EIVLTQSPSSLSASVGDRVTITCQASQDISNYLNWYQQKPGKAPKLLIYDASNLETGVPSRFSGSGSGTDFTFTISSLQPEDIAIYYCQQYDNLPMYTFGQGTKVEIK

SEQ ID NO: 1291 - protein, 452 aa, Artificial Sequence
  Description of Artificial Sequence: Synthetic polypeptide
QVQLVESGGGLVKPGGSLRLSCASSGFTFSSYGMYWVRQAPGKGLEWVSSISTGSSYIYYADSVKGRFTISRDNAKNSLYLQMNSLRAEDTAVYYCARDKGLAVTGYIMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1292 - protein, 215 aa, Artificial Sequence
  Description of Artificial Sequence: Synthetic polypeptide
EIVLTQSPSSLSASVGDRVTITCQASQDISNYLNWYQQKPGKAPKLLIYDASNLETGVPSRFSGSGSGTDFTFTISSLQPEDIAIYYCQQYDNLPMYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1293 - protein, 5 aa, Artificial Sequence
  Description of Artificial Sequence: Synthetic peptide
NYDMN

SEQ ID NO: 1294 - protein, 17 aa, Artificial Sequence
  Description of Artificial Sequence: Synthetic peptide
SISSSSSYIYYADSVKG

SEQ ID NO: 1295 - protein, 15 aa, Artificial Sequence
  Description of Artificial Sequence: Synthetic peptide
DVGVTTDYYYYGMDV

SEQ ID NO: 1296 - protein, 12 aa, Artificial Sequence
  Description of Artificial Sequence: Synthetic peptide
RASQSVASSYLA

SEQ ID NO: 1297 - protein, 7 aa, Artificial Sequence
  Description of Artificial Sequence: Synthetic peptide
GASSRAT

SEQ ID NO: 1298 - protein, 10 aa, Artificial Sequence
  Description of Artificial Sequence: Synthetic peptide
QQYGSSPPYT

SEQ ID NO: 1299 - protein, 7 aa, Artificial Sequence
  Description of Artificial Sequence: Synthetic peptide
GFTFSNY

SEQ ID NO: 1300 - protein, 6 aa, Artificial Sequence
  Description of Artificial Sequence: Synthetic peptide
SSSSSY

SEQ ID NO: 1301 - protein, 14 aa, Artificial Sequence
  Description of Artificial Sequence: Synthetic peptide
DVGVTTDYYYYGMD

SEQ ID NO: 1302 - protein, 8 aa, Artificial Sequence
  Description of Artificial Sequence: Synthetic peptide
SQSVASSY

SEQ ID NO: 1303 - protein, 3 aa, Artificial Sequence
  Description of Artificial Sequence: Synthetic peptide
GAS

SEQ ID NO: 1304 - protein, 7 aa, Artificial Sequence
  Description of Artificial Sequence: Synthetic peptide
YGSSPPY

SEQ ID NO: 1305 - protein, 10 aa, Artificial Sequence
  Description of Artificial Sequence: Synthetic peptide
GFTFSNYDMN

SEQ ID NO: 1306 - protein, 10 aa, Artificial Sequence
  Description of Artificial Sequence: Synthetic peptide
SISSSSSYIY

SEQ ID NO: 1307 - protein, 15 aa, Artificial Sequence
  Description of Artificial Sequence: Synthetic peptide
DVGVTTDYYYYGMDV

SEQ ID NO: 1308 - protein, 12 aa, Artificial Sequence
  Description of Artificial Sequence: Synthetic peptide
RASQSVASSYLA

SEQ ID NO: 1309 - protein, 7 aa, Artificial Sequence
  Description of Artificial Sequence: Synthetic peptide
GASSRAT

SEQ ID NO: 1310 - protein, 10 aa, Artificial Sequence
  Description of Artificial Sequence: Synthetic peptide
QQYGSSPPYT

SEQ ID NO: 1311 - protein, 6 aa, Artificial Sequence
  Description of Artificial Sequence: Synthetic peptide
SNYDMN

SEQ ID NO: 1312 - protein, 13 aa, Artificial Sequence
  Description of Artificial Sequence: Synthetic peptide
WVSSISSSSSYIY

SEQ ID NO: 1313 - protein, 16 aa, Artificial Sequence
  Description of Artificial Sequence: Synthetic peptide
ARDVGVTTDYYYYGMD

SEQ ID NO: 1314 - protein, 8 aa, Artificial Sequence
  Description of Artificial Sequence: Synthetic peptide
ASSYLAWY

SEQ ID NO: 1315 - protein, 10 aa, Artificial Sequence
  Description of Artificial Sequence: Synthetic peptide
LLIYGASSRA

SEQ ID NO: 1316 - protein, 9 aa, Artificial Sequence
  Description of Artificial Sequence: Synthetic peptide
QQYGSSPPY

SEQ ID NO: 1317 - protein, 8 aa, Artificial Sequence
  Description of Artificial Sequence: Synthetic peptide
GFTFSNYD

SEQ ID NO: 1318 - protein, 8 aa, Artificial Sequence
  Description of Artificial Sequence: Synthetic peptide
ISSSSSYI

SEQ ID NO: 1319 - protein, 17 aa, Artificial Sequence
  Description of Artificial Sequence: Synthetic peptide
ARDVGVTTDYYYYGMDV

SEQ ID NO: 1320 - protein, 7 aa, Artificial Sequence
  Description of Artificial Sequence: Synthetic peptide
QSVASSY

SEQ ID NO: 1321 - protein, 3 aa, Artificial Sequence
  Description of Artificial Sequence: Synthetic peptide
GAS

SEQ ID NO: 1322 - protein, 10 aa, Artificial Sequence
  Description of Artificial Sequence: Synthetic peptide
QQYGSSPPYT

SEQ ID NO: 1323 - protein, 124 aa, Artificial Sequence; identical to SEQ ID NO: 371
  Description of Artificial Sequence: Synthetic polypeptide

SEQ ID NO: 1324 - protein, 109 aa, Artificial Sequence
  Description of Artificial Sequence: Synthetic polypeptide
DIVMTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTKVEIK

SEQ ID NO: 1325 - protein, 454 aa, Artificial Sequence; identical to SEQ ID NO: 373
  Description of Artificial Sequence: Synthetic polypeptide

SEQ ID NO: 1326 - protein, 216 aa, Artificial Sequence
  Description of Artificial Sequence: Synthetic polypeptide
DIVMTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1327 - protein, 5 aa, Artificial Sequence
  Description of Artificial Sequence: Synthetic peptide
RYSMN

SEQ ID NO: 1328 - protein, 17 aa, Artificial Sequence
  Description of Artificial Sequence: Synthetic peptide
SISSSSSYIYYADSVKG

SEQ ID NO: 1329 - protein, 13 aa, Artificial Sequence
  Description of Artificial Sequence: Synthetic peptide
DGPTVNWDYYFDL

SEQ ID NO: 1330 - protein, 13 aa, Artificial Sequence
  Description of Artificial Sequence: Synthetic peptide
SGSSSNIGNNYVS

SEQ ID NO: 1331 - protein, 7 aa, Artificial Sequence
  Description of Artificial Sequence: Synthetic peptide
DNNKRPS

SEQ ID NO: 1332 - protein, 12 aa, Artificial Sequence
  Description of Artificial Sequence: Synthetic peptide
GTWDSSLSTSVV

SEQ ID NO: 1333 - protein, 7 aa, Artificial Sequence
  Description of Artificial Sequence: Synthetic peptide
GFTFSRY

SEQ ID NO: 1334 - protein, 6 aa, Artificial Sequence
  Description of Artificial Sequence: Synthetic peptide
SSSSSY

SEQ ID NO: 1335 - protein, 12 aa, Artificial Sequence
  Description of Artificial Sequence: Synthetic peptide
DGPTVNWDYYFD

SEQ ID NO: 1336 - protein, 9 aa, Artificial Sequence
  Description of Artificial Sequence: Synthetic peptide
SSSNIGNNY

SEQ ID NO: 1337 - protein, 3 aa, Artificial Sequence
  Description of Artificial Sequence: Synthetic peptide
DNN

SEQ ID NO: 1338 - protein, 9 aa, Artificial Sequence
  Description of Artificial Sequence: Synthetic peptide
WDSSLSTSV

SEQ ID NO: 1339 - protein, 10 aa, Artificial Sequence
  Description of Artificial Sequence: Synthetic peptide
GFTFSRYSMN

SEQ ID NO: 1340 - protein, 10 aa, Artificial Sequence
  Description of Artificial Sequence: Synthetic peptide
SISSSSSYIY

SEQ ID NO: 1341 - protein, 13 aa, Artificial Sequence
  Description of Artificial Sequence: Synthetic peptide
DGPTVNWDYYFDL

SEQ ID NO: 1342 - protein, 13 aa, Artificial Sequence
  Description of Artificial Sequence: Synthetic peptide
SGSSSNIGNNYVS

SEQ ID NO: 1343 - protein, 7 aa, Artificial Sequence
  Description of Artificial Sequence: Synthetic peptide
DNNKRPS

SEQ ID NO: 1344 - protein, 12 aa, Artificial Sequence
  Description of Artificial Sequence: Synthetic peptide
GTWDSSLSTSVV

SEQ ID NO: 1345 - protein, 6 aa, Artificial Sequence
  Description of Artificial Sequence: Synthetic peptide
SRYSMN

SEQ ID NO: 1346 - protein, 13 aa, Artificial Sequence
  Description of Artificial Sequence: Synthetic peptide
GVSSISSSSSYIY

SEQ ID NO: 1347 - protein, 14 aa, Artificial Sequence
  Description of Artificial Sequence: Synthetic peptide
ARDGPTVNWDYYFD

SEQ ID NO: 1348 - protein, 9 aa, Artificial Sequence
  Description of Artificial Sequence: Synthetic peptide
IGNNYVSWY

SEQ ID NO: 1349 - protein, 10 aa, Artificial Sequence
  Description of Artificial Sequence: Synthetic peptide
LLIYDNNKRP

SEQ ID NO: 1350 - protein, 11 aa, Artificial Sequence
  Description of Artificial Sequence: Synthetic peptide
GTWDSSLSTSV

SEQ ID NO: 1351 - protein, 8 aa, Artificial Sequence
  Description of Artificial Sequence: Synthetic peptide
GFTFSRYS

SEQ ID NO: 1352 - protein, 8 aa, Artificial Sequence
  Description of Artificial Sequence: Synthetic peptide
ISSSSSYI

SEQ ID NO: 1353 - protein, 15 aa, Artificial Sequence
  Description of Artificial Sequence: Synthetic peptide
ARDGPTVNWDYYFDL

SEQ ID NO: 1354 - protein, 8 aa, Artificial Sequence
  Description of Artificial Sequence: Synthetic peptide
SSNIGNNY

SEQ ID NO: 1355 - protein, 3 aa, Artificial Sequence
  Description of Artificial Sequence: Synthetic peptide
DNN

SEQ ID NO: 1356 - protein, 12 aa, Artificial Sequence
  Description of Artificial Sequence: Synthetic peptide
GTWDSSLSTSVV

SEQ ID NO: 1357 - protein, 122 aa, Artificial Sequence
  Description of Artificial Sequence: Synthetic polypeptide
EVQLVQSGGGLVKPGGSLRLSCAASGFTFSRYSMNWVRQAPGKGLEGVSSISSSSSYIYYADSVKGRFTISRDNAKNSLYLQMNSLRAEDTAVYYCARDGPTVNWDYYFDLWGRGTLVTVSS

SEQ ID NO: 1358 - protein, 111 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSTSVVFGGGTKLTVL

SEQ ID NO: 1359 - protein, 452 aa, Artificial Sequence
  Description of Artificial Sequence: Synthetic polypeptide
EVQLVQSGGGLVKPGGSLRLSCAASGFTFSRYSMNWVRQAPGKGLEGVSSISSSSSYIYYADSVKGRFTISRDNAKNSLYLQMNSLRAEDTAVYYCARDGPTVNWDYYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1360 - protein, 217 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSTSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1361 - protein, 7 aa, Artificial Sequence
  Description of Artificial Sequence: Synthetic peptide
SNSAAWN

SEQ ID NO: 1362 - protein, 18 aa, Artificial Sequence
  Description of Artificial Sequence: Synthetic peptide
RTYYRSKWYNDYPISVKS

SEQ ID NO: 1363 - protein, 12 aa, Artificial Sequence
  Description of Artificial Sequence: Synthetic peptide
ESGSYYTDGFDI

SEQ ID NO: 1364 - protein, 11 aa, Artificial Sequence
  Description of Artificial Sequence: Synthetic peptide
RASQGISSYLA

SEQ ID NO: 1365 - protein, 7 aa, Artificial Sequence
  Description of Artificial Sequence: Synthetic peptide
AASTLQS

SEQ ID NO: 1366 - protein, 9 aa, Artificial Sequence
  Description of Artificial Sequence: Synthetic peptide
QEFNSYPYT

SEQ ID NO: 1367 - protein, 9 aa, Artificial Sequence
  Description of Artificial Sequence: Synthetic peptide
GDSVSSNSA

SEQ ID NO: 1368 - protein, 7 aa, Artificial Sequence
  Description of Artificial Sequence: Synthetic peptide
YYRSKWY

SEQ ID NO: 1369 - protein, 11 aa, Artificial Sequence
  Description of Artificial Sequence: Synthetic peptide
ESGSYYTDGFD

SEQ ID NO: 1370 - protein, 7 aa, Artificial Sequence
  Description of Artificial Sequence: Synthetic peptide
SQGISSY

SEQ ID NO: 1371 - protein, 3 aa, Artificial Sequence
  Description of Artificial Sequence: Synthetic peptide
AAS

SEQ ID NO: 1372 - protein, 6 aa, Artificial Sequence
  Description of Artificial Sequence: Synthetic peptide
FNSYPY

SEQ ID NO: 1373 - protein, 12 aa, Artificial Sequence
  Description of Artificial Sequence: Synthetic peptide
GDSVSSNSAAWN

SEQ ID NO: 1374 - protein, 11 aa, Artificial Sequence
  Description of Artificial Sequence: Synthetic peptide
RTYYRSKWYND

SEQ ID NO: 1375 - protein, 12 aa, Artificial Sequence
  Description of Artificial Sequence: Synthetic peptide
ESGSYYTDGFDI

SEQ ID NO: 1376 - protein, 11 aa, Artificial Sequence
  Description of Artificial Sequence: Synthetic peptide
RASQGISSYLA

SEQ ID NO: 1377 - protein, 7 aa, Artificial Sequence
  Description of Artificial Sequence: Synthetic peptide
AASTLQS

SEQ ID NO: 1378 - protein, 9 aa, Artificial Sequence
  Description of Artificial Sequence: Synthetic peptide
QEFNSYPYT

SEQ ID NO: 1379 - protein, 8 aa, Artificial Sequence
  Description of Artificial Sequence: Synthetic peptide
SSNSAAWN

SEQ ID NO: 1380 - protein, 14 aa, Artificial Sequence
  Description of Artificial Sequence: Synthetic peptide
WLGRTYYRSKWYND

SEQ ID NO: 1381 - protein, 13 aa, Artificial Sequence
  Description of Artificial Sequence: Synthetic peptide
ARESGSYYTDGFD

SEQ ID NO: 1382 - protein, 7 aa, Artificial Sequence
  Description of Artificial Sequence: Synthetic peptide
SSYLAWY

SEQ ID NO: 1383 - protein, 10 aa, Artificial Sequence
  Description of Artificial Sequence: Synthetic peptide
LLIYAASTLQ

SEQ ID NO: 1384 - protein, 8 aa, Artificial Sequence
  Description of Artificial Sequence: Synthetic peptide
QEFNSYPY

SEQ ID NO: 1385 - protein, 10 aa, Artificial Sequence
  Description of Artificial Sequence: Synthetic peptide
GDSVSSNSAA

SEQ ID NO: 1386 - protein, 9 aa, Artificial Sequence
  Description of Artificial Sequence: Synthetic peptide
TYYRSKWYN

SEQ ID NO: 1387 - protein, 14 aa, Artificial Sequence
  Description of Artificial Sequence: Synthetic peptide
ARESGSYYTDGFDI

SEQ ID NO: 1388 - protein, 6 aa, Artificial Sequence
  Description of Artificial Sequence: Synthetic peptide
QGISSY

SEQ ID NO: 1389 - protein, 3 aa, Artificial Sequence
  Description of Artificial Sequence: Synthetic peptide
AAS

SEQ ID NO: 1390 - protein, 9 aa, Artificial Sequence
  Description of Artificial Sequence: Synthetic peptide
QEFNSYPYT

SEQ ID NO: 1391 - protein, 124 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYPISVKSRISINPDTSKNQFSLQLNSVTPEDTAVYYCARESGSYYTDGFDIWGQGTMVTVSS

SEQ ID NO: 1392 - protein, 107 aa, Artificial Sequence
  Description of Artificial Sequence: Synthetic polypeptide
DIQMTQSPSFLSASVGDRVTITCRASQGISSYLAWYQQKPGKAPKLLIYAASTLQSGVPSRFSGSGSGTEFTLTISSLQPEDFATYYCQEFNSYPYTFGQGTKLEIK

SEQ ID NO: 1393 - protein, 454 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYPISVKSRISINPDTSKNQFSLQLNSVTPEDTAVYYCARESGSYYTDGFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1394 - protein, 214 aa, Artificial Sequence
  Description of Artificial Sequence: Synthetic polypeptide
DIQMTQSPSFLSASVGDRVTITCRASQGISSYLAWYQQKPGKAPKLLIYAASTLQSGVPSRFSGSGSGTEFTLTISSLQPEDFATYYCQEFNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1395 - protein, 5 aa, Artificial Sequence
  Description of Artificial Sequence: Synthetic peptide
SYTMN

SEQ ID NO: 1396 - protein, 17 aa, Artificial Sequence
  Description of Artificial Sequence: Synthetic peptide
SISSSSSYIDYAESVKG

SEQ ID NO: 1397 - protein, 14 aa, Artificial Sequence
  Description of Artificial Sequence: Synthetic peptide
DGDILATIRGSFDY

SEQ ID NO: 1398 - protein, 17 aa, Artificial Sequence
  Description of Artificial Sequence: Synthetic peptide
RSSQSLLDSDAGNTYLD

SEQ ID NO: 1399 - protein, 7 aa, Artificial Sequence
  Description of Artificial Sequence: Synthetic peptide
TLSYRAS

SEQ ID NO: 1400 - protein, 9 aa, Artificial Sequence
  Description of Artificial Sequence: Synthetic peptide
MQRIEFPIT

SEQ ID NO: 1401 - protein, 7 aa, Artificial Sequence
  Description of Artificial Sequence: Synthetic peptide
GFTFSSY

SEQ ID NO: 1402 - protein, 6 aa, Artificial Sequence
  Description of Artificial Sequence: Synthetic peptide
SSSSSY

SEQ ID NO: 1403 - protein, 13 aa, Artificial Sequence
  Description of Artificial Sequence: Synthetic peptide
DGDILATIRGSFD

SEQ ID NO: 1404 - protein, 13 aa, Artificial Sequence
  Description of Artificial Sequence: Synthetic peptide
SQSLLDSDAGNTY

SEQ ID NO: 1405 - protein, 3 aa, Artificial Sequence
  Description of Artificial Sequence: Synthetic peptide
TLS

SEQ ID NO: 1406 - protein, 6 aa, Artificial Sequence
  Description of Artificial Sequence: Synthetic peptide
RIEFPI

SEQ ID NO: 1407 - protein, 10 aa, Artificial Sequence
  Description of Artificial Sequence: Synthetic peptide
GFTFSSYTMN

SEQ ID NO: 1408 - protein, 10 aa, Artificial Sequence
  Description of Artificial Sequence: Synthetic peptide
SISSSSSYID

SEQ ID NO: 1409 - protein, 14 aa, Artificial Sequence
  Description of Artificial Sequence: Synthetic peptide
DGDILATIRGSFDY

SEQ ID NO: 1410 - protein, 17 aa, Artificial Sequence
  Description of Artificial Sequence: Synthetic peptide
RSSQSLLDSDAGNTYLD

SEQ ID NO: 1411 - protein, 7 aa, Artificial Sequence
  Description of Artificial Sequence: Synthetic peptide
TLSYRAS

SEQ ID NO: 1412 - protein, 9 aa, Artificial Sequence
  Description of Artificial Sequence: Synthetic peptide
MQRIEFPIT

SEQ ID NO: 1413 - protein, 6 aa, Artificial Sequence
  Description of Artificial Sequence: Synthetic peptide
SSYTMN

SEQ ID NO: 1414 - protein, 13 aa, Artificial Sequence
  Description of Artificial Sequence: Synthetic peptide
WVSSISSSSSYID

SEQ ID NO: 1415 - protein, 15 aa, Artificial Sequence
  Description of Artificial Sequence: Synthetic peptide
ARDGDILATIRGSFD

SEQ ID NO: 1416 - protein, 13 aa, Artificial Sequence
  Description of Artificial Sequence: Synthetic peptide
LDSDAGNTYLDWY

SEQ ID NO: 1417 - protein, 10 aa, Artificial Sequence
  Description of Artificial Sequence: Synthetic peptide
LLIYTLSYRA

SEQ ID NO: 1418 - protein, 8 aa, Artificial Sequence
  Description of Artificial Sequence: Synthetic peptide
MQRIEFPI

SEQ ID NO: 1419 - protein, 8 aa, Artificial Sequence
  Description of Artificial Sequence: Synthetic peptide
GFTFSSYT

SEQ ID NO: 1420 - protein, 8 aa, Artificial Sequence
  Description of Artificial Sequence: Synthetic peptide
ISSSSSYI

SEQ ID NO: 1421 - protein, 16 aa, Artificial Sequence
  Description of Artificial Sequence: Synthetic peptide
ARDGDILATIRGSFDY

SEQ ID NO: 1422 - protein, 12 aa, Artificial Sequence
  Description of Artificial Sequence: Synthetic peptide
QSLLDSDAGNTY

SEQ ID NO: 1423 - protein, 3 aa, Artificial Sequence
  Description of Artificial Sequence: Synthetic peptide
TLS

SEQ ID NO: 1424 - protein, 9 aa, Artificial Sequence
  Description of Artificial Sequence: Synthetic peptide
MQRIEFPIT

SEQ ID NO: 1425 - protein, 123 aa, Artificial Sequence
  Description of Artificial Sequence: Synthetic polypeptide
EVQLVESGGGLVKPGGSLRLSCAASGFTFSSYTMNWVRQAPGKGLEWVSSISSSSSYIDYAESVKGRFTISRDNAKNSLYLQMNSLRAEDTAVYYCARDGDILATIRGSFDYWGQGTTVTVSS

SEQ ID NO: 1426 - protein, 113 aa, Artificial Sequence
  Description of Artificial Sequence: Synthetic polypeptide
DIVMTQTPLSLPVTPGEPASISCRSSQSLLDSDAGNTYLDWYLQKPGQSPQLLIYTLSYRASGVPDRFSGSGSGTDFTLKISRVEAEDVAIYYCMQRIEFPITFGQGTKVEIK

SEQ ID NO: 1427 - protein, 453 aa, Artificial Sequence
  Description of Artificial Sequence: Synthetic polypeptide
EVQLVESGGGLVKPGGSLRLSCAASGFTFSSYTMNWVRQAPGKGLEWVSSISSSSSYIDYAESVKGRFTISRDNAKNSLYLQMNSLRAEDTAVYYCARDGDILATIRGSFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1428 - protein, 220 aa, Artificial Sequence
  Description of Artificial Sequence: Synthetic polypeptide
DIVMTQTPLSLPVTPGEPASISCRSSQSLLDSDAGNTYLDWYLQKPGQSPQLLIYTLSYRASGVPDRFSGSGSGTDFTLKISRVEAEDVAIYYCMQRIEFPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1429 - protein, 5 aa, Artificial Sequence
  Description of Artificial Sequence: Synthetic peptide
NYGMN

SEQ ID NO: 1430 - protein, 17 aa, Artificial Sequence
  Description of Artificial Sequence: Synthetic peptide
YISSGSSYKYYADSMKG

SEQ ID NO: 1431 - protein, 14 aa, Artificial Sequence
  Description of Artificial Sequence: Synthetic peptide
DPVVTEYYYYGMDV

SEQ ID NO: 1432 - protein, 11 aa, Artificial Sequence
  Description of Artificial Sequence: Synthetic peptide
RASQGINSWLA

SEQ ID NO: 1433 - protein, 7 aa, Artificial Sequence
  Description of Artificial Sequence: Synthetic peptide
AASSLQS

SEQ ID NO: 1434 - protein, 9 aa, Artificial Sequence
  Description of Artificial Sequence: Synthetic peptide
QQANSFPWT

SEQ ID NO: 1435 - protein, 7 aa, Artificial Sequence
  Description of Artificial Sequence: Synthetic peptide
GFTFSNY

SEQ ID NO: 1436 - protein, 6 aa, Artificial Sequence
  Description of Artificial Sequence: Synthetic peptide
SSGSSY

SEQ ID NO: 1437 - protein, 13 aa, Artificial Sequence
  Description of Artificial Sequence: Synthetic peptide
DPVVTEYYYYGMD

SEQ ID NO: 1438 - protein, 7 aa, Artificial Sequence
  Description of Artificial Sequence: Synthetic peptide
SQGINSW

SEQ ID NO: 1439 - protein, 3 aa, Artificial Sequence
  Description of Artificial Sequence: Synthetic peptide
AAS

SEQ ID NO: 1440 - protein, 6 aa, Artificial Sequence
  Description of Artificial Sequence: Synthetic peptide
ANSFPW

SEQ ID NO: 1441 - protein, 10 aa, Artificial Sequence
  Description of Artificial Sequence: Synthetic peptide
GFTFSNYGMN

SEQ ID NO: 1442 - protein, 10 aa, Artificial Sequence
  Description of Artificial Sequence: Synthetic peptide
YISSGSSYKY

SEQ ID NO: 1443 - protein, 14 aa, Artificial Sequence
  Description of Artificial Sequence: Synthetic peptide
DPVVTEYYYYGMDV

SEQ ID NO: 1444 - protein, 11 aa, Artificial Sequence
  Description of Artificial Sequence: Synthetic peptide
RASQGINSWLA

SEQ ID NO: 1445 - protein, 7 aa, Artificial Sequence
  Description of Artificial Sequence: Synthetic peptide
AASSLQS

SEQ ID NO: 1446 - protein, 9 aa, Artificial Sequence
  Description of Artificial Sequence: Synthetic peptide
QQANSFPWT

SEQ ID NO: 1447 - protein, 6 aa, Artificial Sequence
  Description of Artificial Sequence: Synthetic peptide
SNYGMN

SEQ ID NO: 1448 - protein, 13 aa, Artificial Sequence
  Description of Artificial Sequence: Synthetic peptide
WVSYISSGSSYKY

SEQ ID NO: 1449 - protein, 15 aa, Artificial Sequence
  Description of Artificial Sequence: Synthetic peptide
ARDPVVTEYYYYGMD

SEQ ID NO: 1450 - protein, 7 aa, Artificial Sequence
  Description of Artificial Sequence: Synthetic peptide
NSWLAWY

SEQ ID NO: 1451 - protein, 10 aa, Artificial Sequence
  Description of Artificial Sequence: Synthetic peptide
LLIYAASSLQ

SEQ ID NO: 1452 - protein, 8 aa, Artificial Sequence
  Description of Artificial Sequence: Synthetic peptide
QQANSFPW

SEQ ID NO: 1453 - protein, 8 aa, Artificial Sequence
  Description of Artificial Sequence: Synthetic peptide
GFTFSNYG

SEQ ID NO: 1454 - protein, 8 aa, Artificial Sequence
  Description of Artificial Sequence: Synthetic peptide
ISSGSSYK

SEQ ID NO: 1455 - protein, 16 aa, Artificial Sequence
  Description of Artificial Sequence: Synthetic peptide
ARDPVVTEYYYYGMDV

SEQ ID NO: 1456 - protein, 6 aa, Artificial Sequence
  Description of Artificial Sequence: Synthetic peptide
QGINSW

SEQ ID NO: 1457 - protein, 3 aa, Artificial Sequence
  Description of Artificial Sequence: Synthetic peptide
AAS

SEQ ID NO: 1458 - protein, 9 aa, Artificial Sequence
  Description of Artificial Sequence: Synthetic peptide
QQANSFPWT

SEQ ID NO: 1459 - protein, 123 aa, Artificial Sequence
  Description of Artificial Sequence: Synthetic polypeptide
EVQLVQSGGGLVKPGGSLRLSCAASGFTFSNYGMNWVRQAPGKGLEWVSYISSGSSYKYYADSMKGRFTISRDNAMNLLYLQMNSLRPEDSAMYYCARDPVVTEYYYYGMDVWGQGTMVTVSS

SEQ ID NO: 1460 - protein, 107 aa, Artificial Sequence
  Description of Artificial Sequence: Synthetic polypeptide
DIQMTQSPSSVSASVGDRVTITCRASQGINSWLAWYQQKPGNAPKLLIYAASSLQSGVPSRFSGIGSGTDFIFTISSLQPEDFASYYCQQANSFPWTFGQGTKVDIK

SEQ ID NO: 1461 - protein, 453 aa, Artificial Sequence
  Description of Artificial Sequence: Synthetic polypeptide
EVQLVQSGGGLVKPGGSLRLSCAASGFTFSNYGMNWVRQAPGKGLEWVSYISSGSSYKYYADSMKGRFTISRDNAMNLLYLQMNSLRPEDSAMYYCARDPVVTEYYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1462 - protein, 214 aa, Artificial Sequence
  Description of Artificial Sequence: Synthetic polypeptide
DIQMTQSPSSVSASVGDRVTITCRASQGINSWLAWYQQKPGNAPKLLIYAASSLQSGVPSRFSGIGSGTDFIFTISSLQPEDFASYYCQQANSFPWTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1463 - protein, 5 aa, Artificial Sequence
  Description of Artificial Sequence: Synthetic peptide
AYTMN

SEQ ID NO: 1464 - protein, 17 aa, Artificial Sequence
  Description of Artificial Sequence: Synthetic peptide
SISSSSSYIDFAESVKG

SEQ ID NO: 1465 - protein, 14 aa, Artificial Sequence
  Description of Artificial Sequence: Synthetic peptide
DGDIVSTIRGSFDY

SEQ ID NO: 1466 - protein, 17 aa, Artificial Sequence
  Description of Artificial Sequence: Synthetic peptide
RSSQSLLDSDDGNTYLD

SEQ ID NO: 1467 - protein, 7 aa, Artificial Sequence
  Description of Artificial Sequence: Synthetic peptide
TLSYRAS

SEQ ID NO: 1468 - protein, 9 aa, Artificial Sequence
  Description of Artificial Sequence: Synthetic peptide
MQRIEFPIT

SEQ ID NO: 1469 - protein, 7 aa, Artificial Sequence
  Description of Artificial Sequence: Synthetic peptide
GFTFGAY

SEQ ID NO: 1470 - protein, 6 aa, Artificial Sequence
  Description of Artificial Sequence: Synthetic peptide
SSSSSY

SEQ ID NO: 1471 - protein, 13 aa, Artificial Sequence
  Description of Artificial Sequence: Synthetic peptide
DGDIVSTIRGSFD

SEQ ID NO: 1472 - protein, 13 aa, Artificial Sequence
  Description of Artificial Sequence: Synthetic peptide
SQSLLDSDDGNTY

SEQ ID NO: 1473 - protein, 3 aa, Artificial Sequence
  Description of Artificial Sequence: Synthetic peptide
TLS

SEQ ID NO: 1474 - protein, 6 aa, Artificial Sequence
  Description of Artificial Sequence: Synthetic peptide
RIEFPI

SEQ ID NO: 1475 - protein, 10 aa, Artificial Sequence
  Description of Artificial Sequence: Synthetic peptide
GFTFGAYTMN

SEQ ID NO: 1476 - protein, 10 aa, Artificial Sequence
  Description of Artificial Sequence: Synthetic peptide
SISSSSSYID

SEQ ID NO: 1477 - protein, 14 aa, Artificial Sequence
  Description of Artificial Sequence: Synthetic peptide
DGDIVSTIRGSFDY

SEQ ID NO: 1478 - protein, 17 aa, Artificial Sequence
  Description of Artificial Sequence: Synthetic peptide
RSSQSLLDSDDGNTYLD

SEQ ID NO: 1479 - protein, 7 aa, Artificial Sequence
  Description of Artificial Sequence: Synthetic peptide
TLSYRAS

SEQ ID NO: 1480 - protein, 9 aa, Artificial Sequence
  Description of Artificial Sequence: Synthetic peptide
MQRIEFPIT

SEQ ID NO: 1481 - protein, 6 aa, Artificial Sequence
  Description of Artificial Sequence: Synthetic peptide
GAYTMN

SEQ ID NO: 1482 - protein, 13 aa, Artificial Sequence
  Description of Artificial Sequence: Synthetic peptide
WVSSISSSSSYID

SEQ ID NO: 1483 - protein, 15 aa, Artificial Sequence
  Description of Artificial Sequence: Synthetic peptide
ARDGDIVSTIRGSFD

SEQ ID NO: 1484 - protein, 13 aa, Artificial Sequence
  Description of Artificial Sequence: Synthetic peptide
LDSDDGNTYLDWY

SEQ ID NO: 1485 - protein, 10 aa, Artificial Sequence
  Description of Artificial Sequence: Synthetic peptide
LLIYTLSYRA

SEQ ID NO: 1486 - protein, 8 aa, Artificial Sequence
  Description of Artificial Sequence: Synthetic peptide
MQRIEFPI

SEQ ID NO: 1487 - protein, 8 aa, Artificial Sequence
  Description of Artificial Sequence: Synthetic peptide
GFTFGAYT

SEQ ID NO: 1488 - protein, 8 aa, Artificial Sequence
  Description of Artificial Sequence: Synthetic peptide
ISSSSSYI

SEQ ID NO: 1489 - protein, 16 aa, Artificial Sequence
  Description of Artificial Sequence: Synthetic peptide
ARDGDIVSTIRGSFDY

SEQ ID NO: 1490 - protein, 12 aa, Artificial Sequence
  Description of Artificial Sequence: Synthetic peptide
QSLLDSDDGNTY

SEQ ID NO: 1491 - protein, 3 aa, Artificial Sequence
  Description of Artificial Sequence: Synthetic peptide
TLS

SEQ ID NO: 1492 - protein, 9 aa, Artificial Sequence
  Description of Artificial Sequence: Synthetic peptide
MQRIEFPIT

SEQ ID NO: 1493 - protein, 123 aa, Artificial Sequence
  Description of Artificial Sequence: Synthetic polypeptide
QVQLVESGGGLVKPGGSLRLSCTASGFTFGAYTMNWVRQAPGKGLEWVSSISSSSSYIDFAESVKGRFTISRDNAKNSLYLQMISLRAEDTAVYYCARDGDIVSTIRGSFDYWGQGALVTVSS

SEQ ID NO: 1494 - protein, 113 aa, Artificial Sequence
  Description of Artificial Sequence: Synthetic polypeptide
EIVMTQSPLSLPVTPGEPASISCRSSQSLLDSDDGNTYLDWYLQKPGQSPQLLIYTLSYRASGVPDRFSGSGSGTDFTLKISRVEAEDVGIYYCMQRIEFPITFGQGTKVEIK

SEQ ID NO: 1495 - protein, 453 aa, Artificial Sequence
  Description of Artificial Sequence: Synthetic polypeptide
QVQLVESGGGLVKPGGSLRLSCTASGFTFGAYTMNWVRQAPGKGLEWVSSISSSSSYIDFAESVKGRFTISRDNAKNSLYLQMISLRAEDTAVYYCARDGDIVSTIRGSFDYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1496 - protein, 220 aa, Artificial Sequence
  Description of Artificial Sequence: Synthetic polypeptide
EIVMTQSPLSLPVTPGEPASISCRSSQSLLDSDDGNTYLDWYLQKPGQSPQLLIYTLSYRASGVPDRFSGSGSGTDFTLKISRVEAEDVGIYYCMQRIEFPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1497 - protein, 5 aa, Artificial Sequence
  Description of Artificial Sequence: Synthetic peptide
SYSMD

SEQ ID NO: 1498 - protein, 17 aa, Artificial Sequence
  Description of Artificial Sequence: Synthetic peptide
SIGSSSSYIFYADSVKG

SEQ ID NO: 1499 - protein, 12 aa, Artificial Sequence
  Description of Artificial Sequence: Synthetic peptide
SYSWNYGGAFDI

SEQ ID NO: 1500 - protein, 12 aa, Artificial Sequence
  Description of Artificial Sequence: Synthetic peptide
RASQSVSSSYLA

SEQ ID NO: 1501 - protein, 7 aa, Artificial Sequence
  Description of Artificial Sequence: Synthetic peptide
GASSRAT

SEQ ID NO: 1502 - protein, 10 aa, Artificial Sequence
  Description of Artificial Sequence: Synthetic peptide
QQYGSSPPYT

SEQ ID NO: 1503 - protein, 7 aa, Artificial Sequence
  Description of Artificial Sequence: Synthetic peptide
GITFSSY

SEQ ID NO: 1504 - protein, 6 aa, Artificial Sequence
  Description of Artificial Sequence: Synthetic peptide
GSSSSY

SEQ ID NO: 1505 - protein, 11 aa, Artificial Sequence
  Description of Artificial Sequence: Synthetic peptide
SYSWNYGGAFD

SEQ ID NO: 1506 - protein, 8 aa, Artificial Sequence
  Description of Artificial Sequence: Synthetic peptide
SQSVSSSY

SEQ ID NO: 1507 - protein, 3 aa, Artificial Sequence
  Description of Artificial Sequence: Synthetic peptide
GAS

SEQ ID NO: 1508 - protein, 7 aa, Artificial Sequence
  Description of Artificial Sequence: Synthetic peptide
YGSSPPY

SEQ ID NO: 1509 - protein, 10 aa, Artificial Sequence
  Description of Artificial Sequence: Synthetic peptide
GITFSSYSMD

SEQ ID NO: 1510 - protein, 10 aa, Artificial Sequence
  Description of Artificial Sequence: Synthetic peptide
SIGSSSSYIF

SEQ ID NO: 1511 - protein, 12 aa, Artificial Sequence
  Description of Artificial Sequence: Synthetic peptide
SYSWNYGGAFDI

SEQ ID NO: 1512 - protein, 12 aa, Artificial Sequence
  Description of Artificial Sequence: Synthetic peptide
RASQSVSSSYLA

SEQ ID NO: 1513 - protein, 7 aa, Artificial Sequence
  Description of Artificial Sequence: Synthetic peptide
GASSRAT

SEQ ID NO: 1514 - protein, 10 aa, Artificial Sequence
  Description of Artificial Sequence: Synthetic peptide
QQYGSSPPYT

SEQ ID NO: 1515 - protein, 6 aa, Artificial Sequence
  Description of Artificial Sequence: Synthetic peptide
SSYSMD

SEQ ID NO: 1516 - protein, 13 aa, Artificial Sequence
  Description of Artificial Sequence: Synthetic peptide
WVSSIGSSSSYIF

SEQ ID NO: 1517 - protein, 13 aa, Artificial Sequence
  Description of Artificial Sequence: Synthetic peptide
ATSYSWNYGGAFD

SEQ ID NO: 1518 - protein, 8 aa, Artificial Sequence
  Description of Artificial Sequence: Synthetic peptide
SSSYLAWY

SEQ ID NO: 1519 - protein, 10 aa, Artificial Sequence
  Description of Artificial Sequence: Synthetic peptide
LLIYGASSRA

SEQ ID NO: 1520 - protein, 9 aa, Artificial Sequence
  Description of Artificial Sequence: Synthetic peptide
QQYGSSPPY

SEQ ID NO: 1521 - protein, 8 aa, Artificial Sequence
  Description of Artificial Sequence: Synthetic peptide
GITFSSYS

SEQ ID NO: 1522 - protein, 8 aa, Artificial Sequence
  Description of Artificial Sequence: Synthetic peptide
IGSSSSYI

SEQ ID NO: 1523 - protein, 14 aa, Artificial Sequence
  Description of Artificial Sequence: Synthetic peptide
ATSYSWNYGGAFDI

SEQ ID NO: 1524 - protein, 7 aa, Artificial Sequence
  Description of Artificial Sequence: Synthetic peptide
QSVSSSY

SEQ ID NO: 1525 - protein, 3 aa, Artificial Sequence
  Description of Artificial Sequence: Synthetic peptide
GAS

SEQ ID NO: 1526 - protein, 10 aa, Artificial Sequence
  Description of Artificial Sequence: Synthetic peptide
QQYGSSPPYT

SEQ ID NO: 1527 - protein, 121 aa, Artificial Sequence
  Description of Artificial Sequence: Synthetic polypeptide
EVQLVESGGGLVKPGGSLRLSCAAFGITFSSYSMDWVRQAPGRGLEWVSSIGSSSSYIFYADSVKGRFTISRDNAKNSLYLQMNSLRAEDTAVYYCATSYSWNYGGAFDIWGQGTMVTVSS

SEQ ID NO: 1528 - protein, 109 aa, Artificial Sequence
  Description of Artificial Sequence: Synthetic polypeptide
EIVMTQSPGTLSLSPGERATLSCRASQSVSSSYLAWYQQKPGQAPRLLIYGASSRATGIPDRFSGSGSGTDFTLTISRLEPEDFAVYFCQQYGSSPPYTFGQGTKVEIK

SEQ ID NO: 1529 - protein, 451 aa, Artificial Sequence
  Description of Artificial Sequence: Synthetic polypeptide
EVQLVESGGGLVKPGGSLRLSCAAFGITFSSYSMDWVRQAPGRGLEWVSSIGSSSSYIFYADSVKGRFTISRDNAKNSLYLQMNSLRAEDTAVYYCATSYSWNYGGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1530 - protein, 216 aa, Artificial Sequence
  Description of Artificial Sequence: Synthetic polypeptide
EIVMTQSPGTLSLSPGERATLSCRASQSVSSSYLAWYQQKPGQAPRLLIYGASSRATGIPDRFSGSGSGTDFTLTISRLEPEDFAVYFCQQYGSSPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1531 - protein, 5 aa, Artificial Sequence
  Description of Artificial Sequence: Synthetic peptide
SYNMN

SEQ ID NO: 1532 - protein, 17 aa, Artificial Sequence
  Description of Artificial Sequence: Synthetic peptide
SISTSSSYIYYADSVKG

SEQ ID NO: 1533 - protein, 13 aa, Artificial Sequence
  Description of Artificial Sequence: Synthetic peptide
DTSVTKYPDTFDI

SEQ ID NO: 1534 - protein, 11 aa, Artificial Sequence
  Description of Artificial Sequence: Synthetic peptide
RASQDINNYLA

SEQ ID NO: 1535 - protein, 7 aa, Artificial Sequence
  Description of Artificial Sequence: Synthetic peptide
GASTLQS

SEQ ID NO: 1536 - protein, 9 aa, Artificial Sequence
  Description of Artificial Sequence: Synthetic peptide
QKYNSAPFT

SEQ ID NO: 1537 - protein, 7 aa, Artificial Sequence
  Description of Artificial Sequence: Synthetic peptide
GFTFSSY

SEQ ID NO: 1538 - protein, 6 aa, Artificial Sequence
  Description of Artificial Sequence: Synthetic peptide
STSSSY

SEQ ID NO: 1539 - protein, 12 aa, Artificial Sequence
  Description of Artificial Sequence: Synthetic peptide
DTSVTKYPDTFD

SEQ ID NO: 1540 - protein, 7 aa, Artificial Sequence
  Description of Artificial Sequence: Synthetic peptide
SQDINNY

SEQ ID NO: 1541 - protein, 3 aa, Artificial Sequence
  Description of Artificial Sequence: Synthetic peptide
GAS

SEQ ID NO: 1542 - protein, 6 aa, Artificial Sequence
  Description of Artificial Sequence: Synthetic peptide
YNSAPF

SEQ ID NO: 1543 - protein, 10 aa, Artificial Sequence
  Description of Artificial Sequence: Synthetic peptide
GFTFSSYNMN

SEQ ID NO: 1544 - protein, 10 aa, Artificial Sequence
  Description of Artificial Sequence: Synthetic peptide
SISTSSSYIY

SEQ ID NO: 1545 - protein, 13 aa, Artificial Sequence
  Description of Artificial Sequence: Synthetic peptide
DTSVTKYPDTFDI

SEQ ID NO: 1546 - protein, 11 aa, Artificial Sequence
  Description of Artificial Sequence: Synthetic peptide
RASQDINNYLA

SEQ ID NO: 1547 - protein, 7 aa, Artificial Sequence
  Description of Artificial Sequence: Synthetic peptide
GASTLQS

SEQ ID NO: 1548 - protein, 9 aa, Artificial Sequence
  Description of Artificial Sequence: Synthetic peptide
QKYNSAPFT

SEQ ID NO: 1549 - protein, 6 aa, Artificial Sequence
  Description of Artificial Sequence: Synthetic peptide
SSYNMN

SEQ ID NO: 1550 - protein, 13 aa, Artificial Sequence
  Description of Artificial Sequence: Synthetic peptide
WVSSISTSSSYIY

SEQ ID NO: 1551 - protein, 14 aa, Artificial Sequence
  Description of Artificial Sequence: Synthetic peptide
ARDTSVTKYPDTFD

SEQ ID NO: 1552 - protein, 7 aa, Artificial Sequence
  Description of Artificial Sequence: Synthetic peptide
NNYLAWF

SEQ ID NO: 1553 - protein, 10 aa, Artificial Sequence
  Description of Artificial Sequence: Synthetic peptide
LLIYGASTLQ

SEQ ID NO: 1554 - protein, 8 aa, Artificial Sequence
  Description of Artificial Sequence: Synthetic peptide
QKYNSAPF

SEQ ID NO: 1555 - protein, 8 aa, Artificial Sequence
  Description of Artificial Sequence: Synthetic peptide
GFTFSSYN

SEQ ID NO: 1556 - protein, 8 aa, Artificial Sequence
  Description of Artificial Sequence: Synthetic peptide
ISTSSSYI

SEQ ID NO: 1557 - protein, 15 aa, Artificial Sequence
  Description of Artificial Sequence: Synthetic peptide
ARDTSVTKYPDTFDI

SEQ ID NO: 1558 - protein, 6 aa, Artificial Sequence
  Description of Artificial Sequence: Synthetic peptide
QDINNY

SEQ ID NO: 1559 - protein, 3 aa, Artificial Sequence
  Description of Artificial Sequence: Synthetic peptide
GAS

SEQ ID NO: 1560 - protein, 9 aa, Artificial Sequence
  Description of Artificial Sequence: Synthetic peptide
QKYNSAPFT

SEQ ID NO: 1561 - protein, 122 aa, Artificial Sequence
  Description of Artificial Sequence: Synthetic polypeptide
EVQLVESGGGLVKPGGSLRLSCAASGFTFSSYNMNWVRQAPGKGLEWVSSISTSSSYIYYADSVKGRFTISRDNAKNSLYLQMNGLRAEDTAVYYCARDTSVTKYPDTFDIWGQGTMVTVSS

SEQ ID NO: 1562 - protein, 107 aa, Artificial Sequence
  Description of Artificial Sequence: Synthetic polypeptide
DIVMTQSPSSLSASVGDRVTITCRASQDINNYLAWFQQKPGKVPNLLIYGASTLQSGVPSRFTGSGSGTDFTLTISSLQPEDVATYYCQKYNSAPFTFGPGTKVDIK

SEQ ID NO: 1563 - protein, 452 aa, Artificial Sequence
  Description of Artificial Sequence: Synthetic polypeptide
EVQLVESGGGLVKPGGSLRLSCAASGFTFSSYNMNWVRQAPGKGLEWVSSISTSSSYIYYADSVKGRFTISRDNAKNSLYLQMNGLRAEDTAVYYCARDTSVTKYPDTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1564 - protein, 214 aa, Artificial Sequence
  Description of Artificial Sequence: Synthetic polypeptide
DIVMTQSPSSLSASVGDRVTITCRASQDINNYLAWFQQKPGKVPNLLIYGASTLQSGVPSRFTGSGSGTDFTLTISSLQPEDVATYYCQKYNSAPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1565 - protein, 5 aa, Artificial Sequence
  Description of Artificial Sequence: Synthetic peptide
GDYMH

SEQ ID NO: 1566 - protein, 17 aa, Artificial Sequence
  Description of Artificial Sequence: Synthetic peptide
WINPNSGYTNYAQKFQG

SEQ ID NO: 1567 - protein, 7 aa, Artificial Sequence
  Description of Artificial Sequence: Synthetic peptide
EGDAFDV

SEQ ID NO: 1568 - protein, 14 aa, Artificial Sequence
  Description of Artificial Sequence: Synthetic peptide
TGTSSDVGGYNYVS

SEQ ID NO: 1569 - protein, 7 aa, Artificial Sequence
  Description of Artificial Sequence: Synthetic peptide
EVSKRPS

SEQ ID NO: 1570 - protein, 11 aa, Artificial Sequence
  Description of Artificial Sequence: Synthetic peptide
NSYAGSNNFEV

SEQ ID NO: 1571 - protein, 7 aa, Artificial Sequence
  Description of Artificial Sequence: Synthetic peptide
GYTFTGD

SEQ ID NO: 1572 - protein, 6 aa, Artificial Sequence
  Description of Artificial Sequence: Synthetic peptide
NPNSGY

SEQ ID NO: 1573 - protein, 6 aa, Artificial Sequence
  Description of Artificial Sequence: Synthetic peptide
EGDAFD

SEQ ID NO: 1574 - protein, 10 aa, Artificial Sequence
  Description of Artificial Sequence: Synthetic peptide
TSSDVGGYNY

SEQ ID NO: 1575 - protein, 3 aa, Artificial Sequence
  Description of Artificial Sequence: Synthetic peptide
EVS

SEQ ID NO: 1576 - protein, 8 aa, Artificial Sequence
  Description of Artificial Sequence: Synthetic peptide
YAGSNNFE

SEQ ID NO: 1577 - protein, 10 aa, Artificial Sequence
  Description of Artificial Sequence: Synthetic peptide
GYTFTGDYMH

SEQ ID NO: 1578 - protein, 10 aa, Artificial Sequence
  Description of Artificial Sequence: Synthetic peptide
WINPNSGYTN

SEQ ID NO: 1579 - protein, 7 aa, Artificial Sequence
  Description of Artificial Sequence: Synthetic peptide
EGDAFDV

SEQ ID NO: 1580 - protein, 14 aa, Artificial Sequence
  Description of Artificial Sequence: Synthetic peptide
TGTSSDVGGYNYVS

SEQ ID NO: 1581 - protein, 7 aa, Artificial Sequence
  Description of Artificial Sequence: Synthetic peptide
EVSKRPS

SEQ ID NO: 1582 - protein, 11 aa, Artificial Sequence
  Description of Artificial Sequence: Synthetic peptide
NSYAGSNNFEV

SEQ ID NO: 1583 - protein, 6 aa, Artificial Sequence
  Description of Artificial Sequence: Synthetic peptide
TGDYMH

SEQ ID NO: 1584 - protein, 13 aa, Artificial Sequence
  Description of Artificial Sequence: Synthetic peptide
WMGWINPNSGYTN

SEQ ID NO: 1585 - protein, 8 aa, Artificial Sequence
  Description of Artificial Sequence: Synthetic peptide
AREGDAFD

SEQ ID NO: 1586 - protein, 10 aa, Artificial Sequence
  Description of Artificial Sequence: Synthetic peptide
VGGYNYVSWY

SEQ ID NO: 1587 - protein, 10 aa, Artificial Sequence
  Description of Artificial Sequence: Synthetic peptide
LMIYEVSKRP

SEQ ID NO: 1588 - protein, 10 aa, Artificial Sequence
  Description of Artificial Sequence: Synthetic peptide
NSYAGSNNFE

SEQ ID NO: 1589 - protein, 8 aa, Artificial Sequence
  Description of Artificial Sequence: Synthetic peptide
GYTFTGDY

SEQ ID NO: 1590 - protein, 8 aa, Artificial Sequence
  Description of Artificial Sequence: Synthetic peptide
INPNSGYT

SEQ ID NO: 1591 - protein, 9 aa, Artificial Sequence
  Description of Artificial Sequence: Synthetic peptide
AREGDAFDV

SEQ ID NO: 1592 - protein, 9 aa, Artificial Sequence
  Description of Artificial Sequence: Synthetic peptide
SSDVGGYNY

SEQ ID NO: 1593 - protein, 3 aa, Artificial Sequence
  Description of Artificial Sequence: Synthetic peptide
EVS

SEQ ID NO: 1594 - protein, 11 aa, Artificial Sequence
  Description of Artificial Sequence: Synthetic peptide
NSYAGSNNFEV

SEQ ID NO: 1595 - protein, 116 aa, Artificial Sequence
  Description of Artificial Sequence: Synthetic polypeptide
QVQLVESGAEVTKPGASVKVSCKASGYTFTGDYMHWVRQAPGQGLEWMGWINPNSGYTNYAQKFQGRVTMTRDTSISTAYMELSRLRSDDTAVYYCAREGDAFDVWGQGTMVTVSS

SEQ ID NO: 1596 - protein, 111 aa, Artificial Sequence
  Description of Artificial Sequence: Synthetic polypeptide
QLVLTQSSSASGSPGQSVTISCTGTSSDVGGYNYVSWYQQHPGKAPKLMIYEVSKRPSGVPDRFSGSKSGNTASLTVSGLQAEDEADYYCNSYAGSNNFEVFGGGTKLTVL

SEQ ID NO: 1597 - protein, 446 aa, Artificial Sequence
  Description of Artificial Sequence: Synthetic polypeptide
QVQLVESGAEVTKPGASVKVSCKASGYTFTGDYMHWVRQAPGQGLEWMGWINPNSGYTNYAQKFQGRVTMTRDTSISTAYMELSRLRSDDTAVYYCAREGDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1598 - protein, 217 aa, Artificial Sequence
  Description of Artificial Sequence: Synthetic polypeptide
QLVLTQSSSASGSPGQSVTISCTGTSSDVGGYNYVSWYQQHPGKAPKLMIYEVSKRPSGVPDRFSGSKSGNTASLTVSGLQAEDEADYYCNSYAGSNNFEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1599 - protein, 5 aa, Artificial Sequence
  Description of Artificial Sequence: Synthetic peptide
SYSMI

SEQ ID NO: 1600 - protein, 17 aa, Artificial Sequence
  Description of Artificial Sequence: Synthetic peptide
SISSSSDYIYNADSVKG

SEQ ID NO: 1601 - protein, 9 aa, Artificial Sequence
  Description of Artificial Sequence: Synthetic peptide
DWELLGFDC

SEQ ID NO: 1602 - protein, 11 aa, Artificial Sequence
  Description of Artificial Sequence: Synthetic peptide
SGDKLGDKYAC

SEQ ID NO: 1603 - protein, 7 aa, Artificial Sequence
  Description of Artificial Sequence: Synthetic peptide
QHNKRPS

SEQ ID NO: 1604 - protein, 9 aa, Artificial Sequence
  Description of Artificial Sequence: Synthetic peptide
QAWDSTTVV

SEQ ID NO: 1605 - protein, 7 aa, Artificial Sequence
  Description of Artificial Sequence: Synthetic peptide
GFTFSSY

SEQ ID NO: 1606 - protein, 6 aa, Artificial Sequence
  Description of Artificial Sequence: Synthetic peptide
SSSSDY

SEQ ID NO: 1607 - protein, 8 aa, Artificial Sequence
  Description of Artificial Sequence: Synthetic peptide
DWELLGFD

SEQ ID NO: 1608 - protein, 7 aa, Artificial Sequence
  Description of Artificial Sequence: Synthetic peptide
DKLGDKY

SEQ ID NO: 1609 - protein, 3 aa, Artificial Sequence
  Description of Artificial Sequence: Synthetic peptide
QHN

SEQ ID NO: 1610 - protein, 6 aa, Artificial Sequence
  Description of Artificial Sequence: Synthetic peptide
WDSTTV

SEQ ID NO: 1611 - protein, 10 aa, Artificial Sequence
  Description of Artificial Sequence: Synthetic peptide
GFTFSSYSMI

SEQ ID NO: 1612 - protein, 10 aa, Artificial Sequence
  Description of Artificial Sequence: Synthetic peptide
SISSSSDYIY

SEQ ID NO: 1613 - protein, 9 aa, Artificial Sequence
  Description of Artificial Sequence: Synthetic peptide
DWELLGFDC

SEQ ID NO: 1614 - protein, 11 aa, Artificial Sequence
  Description of Artificial Sequence: Synthetic peptide
SGDKLGDKYAC

SEQ ID NO: 1615 - protein, 7 aa, Artificial Sequence
  Description of Artificial Sequence: Synthetic peptide
QHNKRPS

SEQ ID NO: 1616 - protein, 9 aa, Artificial Sequence
  Description of Artificial Sequence: Synthetic peptide
QAWDSTTVV

SEQ ID NO: 1617 - protein, 6 aa, Artificial Sequence
  Description of Artificial Sequence: Synthetic peptide
SSYSMI

SEQ ID NO: 1618 - protein, 13 aa, Artificial Sequence
  Description of Artificial Sequence: Synthetic peptide
WVSSISSSSDYIY

SEQ ID NO: 1619 - protein, 10 aa, Artificial Sequence
  Description of Artificial Sequence: Synthetic peptide
ARDWELLGFD

SEQ ID NO: 1620 - protein, 7 aa, Artificial Sequence
  Description of Artificial Sequence: Synthetic peptide
DKYACWY

SEQ ID NO: 1621 - protein, 10 aa, Artificial Sequence
  Description of Artificial Sequence: Synthetic peptide
LVIYQHNKRP

SEQ ID NO: 1622 - protein, 8 aa, Artificial Sequence
  Description of Artificial Sequence: Synthetic peptide
QAWDSTTV

SEQ ID NO: 1623 - protein, 8 aa, Artificial Sequence
  Description of Artificial Sequence: Synthetic peptide
GFTFSSYS

SEQ ID NO: 1624 - protein, 8 aa, Artificial Sequence
  Description of Artificial Sequence: Synthetic peptide
ISSSSDYI

SEQ ID NO: 1625 - protein, 11 aa, Artificial Sequence
  Description of Artificial Sequence: Synthetic peptide
ARDWELLGFDC

SEQ ID NO: 1626 - protein, 6 aa, Artificial Sequence
  Description of Artificial Sequence: Synthetic peptide
KLGDKY

SEQ ID NO: 1627 - protein, 3 aa, Artificial Sequence
  Description of Artificial Sequence: Synthetic peptide
QHN

SEQ ID NO: 1628 - protein, 9 aa, Artificial Sequence
  Description of Artificial Sequence: Synthetic peptide
QAWDSTTVV

SEQ ID NO: 1629 - protein, 118 aa, Artificial Sequence
  Description of Artificial Sequence: Synthetic polypeptide
EVQLVESGGGLVRPGGSLRLSCEASGFTFSSYSMIWVRQAPGKGLEWVSSISSSSDYIYNADSVKGRFTISRDNAKNSLYLQMNSLRAEDTAVYYCARDWELLGFDCWGQGTTVTVSS

SEQ ID NO: 1630 - protein, 106 aa, Artificial Sequence; identical to SEQ ID NO: 236
  Description of Artificial Sequence: Synthetic polypeptide

SEQ ID NO: 1631 - protein, 448 aa, Artificial Sequence
  Description of Artificial Sequence: Synthetic polypeptide
EVQLVESGGGLVRPGGSLRLSCEASGFTFSSYSMIWVRQAPGKGLEWVSSISSSSDYIYNADSVKGRFTISRDNAKNSLYLQMNSLRAEDTAVYYCARDWELLGFDCWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1632 - protein, 212 aa, Artificial Sequence; identical to SEQ ID NO: 238
  Description of Artificial Sequence: Synthetic polypeptide

SEQ ID NO: 1633 - protein, 7 aa, Artificial Sequence
  Description of Artificial Sequence: Synthetic peptide
ISGVSVG

SEQ ID NO: 1634 - protein, 16 aa, Artificial Sequence
  Description of Artificial Sequence: Synthetic peptide
LIYWNDDKRYSPSLQS

SEQ ID NO: 1635 - protein, 12 aa, Artificial Sequence
  Description of Artificial Sequence: Synthetic peptide
SGQWLEGDAFDI

SEQ ID NO: 1636 - protein, 16 aa, Artificial Sequence
  Description of Artificial Sequence: Synthetic peptide
RSSESLVHSDGNTYLS

SEQ ID NO: 1637 - protein, 7 aa, Artificial Sequence
  Description of Artificial Sequence: Synthetic peptide
KISNRFS

SEQ ID NO: 1638 - protein, 9 aa, Artificial Sequence
  Description of Artificial Sequence: Synthetic peptide
MQATQFPLT

SEQ ID NO: 1639 - protein, 9 aa, Artificial Sequence
  Description of Artificial Sequence: Synthetic peptide
GFSLSISGV

SEQ ID NO: 1640 - protein, 5 aa, Artificial Sequence
  Description of Artificial Sequence: Synthetic peptide
YWNDD

SEQ ID NO: 1641 - protein, 11 aa, Artificial Sequence
  Description of Artificial Sequence: Synthetic peptide
SGQWLEGDAFD

SEQ ID NO: 1642 - protein, 12 aa, Artificial Sequence
  Description of Artificial Sequence: Synthetic peptide
SESLVHSDGNTY

SEQ ID NO: 1643 - protein, 3 aa, Artificial Sequence
  Description of Artificial Sequence: Synthetic peptide
KIS

SEQ ID NO: 1644 - protein, 6 aa, Artificial Sequence
  Description of Artificial Sequence: Synthetic peptide
ATQFPL

SEQ ID NO: 1645 - protein, 12 aa, Artificial Sequence
  Description of Artificial Sequence: Synthetic peptide
GFSLSISGVSVG

SEQ ID NO: 1646 - protein, 9 aa, Artificial Sequence
  Description of Artificial Sequence: Synthetic peptide
LIYWNDDKR

SEQ ID NO: 1647 - protein, 12 aa, Artificial Sequence
  Description of Artificial Sequence: Synthetic peptide
SGQWLEGDAFDI

SEQ ID NO: 1648 - protein, 16 aa, Artificial Sequence
  Description of Artificial Sequence: Synthetic peptide
RSSESLVHSDGNTYLS

SEQ ID NO: 1649 - protein, 7 aa, Artificial Sequence
  Description of Artificial Sequence: Synthetic peptide
KISNRFS

SEQ ID NO: 1650 - protein, 9 aa, Artificial Sequence
  Description of Artificial Sequence: Synthetic peptide
MQATQFPLT

SEQ ID NO: 1651 - protein, 8 aa, Artificial Sequence
  Description of Artificial Sequence: Synthetic peptide
SISGVSVG

SEQ ID NO: 1652 - protein, 12 aa, Artificial Sequence
  Description of Artificial Sequence: Synthetic peptide
WLALIYWNDDKR

SEQ ID NO: 1653 - protein, 13 aa, Artificial Sequence
  Description of Artificial Sequence: Synthetic peptide
VHSGQWLEGDAFD

SEQ ID NO: 1654 - protein, 12 aa, Artificial Sequence
  Description of Artificial Sequence: Synthetic peptide
VHSDGNTYLSWL

SEQ ID NO: 1655 - protein, 10 aa, Artificial Sequence
  Description of Artificial Sequence: Synthetic peptide
LLIYKISNRF

SEQ ID NO: 1656 - protein, 8 aa, Artificial Sequence
  Description of Artificial Sequence: Synthetic peptide
MQATQFPL

SEQ ID NO: 1657 - protein, 10 aa, Artificial Sequence
  Description of Artificial Sequence: Synthetic peptide
GFSLSISGVS

SEQ ID NO: 1658 - protein, 7 aa, Artificial Sequence
  Description of Artificial Sequence: Synthetic peptide
IYWNDDK

SEQ ID NO: 1659 - protein, 14 aa, Artificial Sequence
  Description of Artificial Sequence: Synthetic peptide
VHSGQWLEGDAFDI

SEQ ID NO: 1660 - protein, 11 aa, Artificial Sequence
  Description of Artificial Sequence: Synthetic peptide
ESLVHSDGNTY

SEQ ID NO: 1661 - protein, 3 aa, Artificial Sequence
  Description of Artificial Sequence: Synthetic peptide
KIS

SEQ ID NO: 1662 - protein, 9 aa, Artificial Sequence
  Description of Artificial Sequence: Synthetic peptide
MQATQFPLT

SEQ ID NO: 1663 - protein, 122 aa, Artificial Sequence
  Description of Artificial Sequence: Synthetic polypeptide
QVQLVESGPTLVKPTQTLTLTCTFSGFSLSISGVSVGWIRQPPGKALEWLALIYWNDDKRYSPSLQSRVTITKDTSKNQVVLTVTNMDSVDTATYYCVHSGQWLEGDAFDIWGQGTMVTVSS

SEQ ID NO: 1664 - protein, 112 aa, Artificial Sequence
  Description of Artificial Sequence: Synthetic polypeptide
DIVMTQTPLSSPVTLGQPASISCRSSESLVHSDGNTYLSWLQQSPGQPPRLLIYKISNRFSGVPDRFSGSGAGTDFTLKISRVEAEDVGVYYCMQATQFPLTFGGGTKLEIK

SEQ ID NO: 1665 - protein, 452 aa, Artificial Sequence
  Description of Artificial Sequence: Synthetic polypeptide
QVQLVESGPTLVKPTQTLTLTCTFSGFSLSISGVSVGWIRQPPGKALEWLALIYWNDDKRYSPSLQSRVTITKDTSKNQVVLTVTNMDSVDTATYYCVHSGQWLEGDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1666 - protein, 219 aa, Artificial Sequence
  Description of Artificial Sequence: Synthetic polypeptide
DIVMTQTPLSSPVTLGQPASISCRSSESLVHSDGNTYLSWLQQSPGQPPRLLIYKISNRFSGVPDRFSGSGAGTDFTLKISRVEAEDVGVYYCMQATQFPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1667 - protein, 5 aa, Artificial Sequence
  Description of Artificial Sequence: Synthetic peptide
NYDMN

SEQ ID NO: 1668 - protein, 17 aa, Artificial Sequence
  Description of Artificial Sequence: Synthetic peptide
SISSSSHYIYYADSLKG

SEQ ID NO: 1669 - protein, 15 aa, Artificial Sequence
  Description of Artificial Sequence: Synthetic peptide
DRGVTTDYYYYALDV

SEQ ID NO: 1670 - protein, 11 aa, Artificial Sequence
  Description of Artificial Sequence: Synthetic peptide
RASQGIYNYLA

SEQ ID NO: 1671 - protein, 7 aa, Artificial Sequence
  Description of Artificial Sequence: Synthetic peptide
AASTLQS

SEQ ID NO: 1672 - protein, 9 aa, Artificial Sequence
  Description of Artificial Sequence: Synthetic peptide
QKYNRAPFT

SEQ ID NO: 1673 - protein, 7 aa, Artificial Sequence
  Description of Artificial Sequence: Synthetic peptide
GFSFSNY

SEQ ID NO: 1674 - protein, 6 aa, Artificial Sequence
  Description of Artificial Sequence: Synthetic peptide
SSSSHY

SEQ ID NO: 1675 - protein, 14 aa, Artificial Sequence
  Description of Artificial Sequence: Synthetic peptide
DRGVTTDYYYYALD

SEQ ID NO: 1676 - protein, 7 aa, Artificial Sequence
  Description of Artificial Sequence: Synthetic peptide
SQGIYNY

SEQ ID NO: 1677 - protein, 3 aa, Artificial Sequence
  Description of Artificial Sequence: Synthetic peptide
AAS

SEQ ID NO: 1678 - protein, 6 aa, Artificial Sequence
  Description of Artificial Sequence: Synthetic peptide
YNRAPF

SEQ ID NO: 1679 - protein, 10 aa, Artificial Sequence
  Description of Artificial Sequence: Synthetic peptide
GFSFSNYDMN

SEQ ID NO: 1680 - protein, 10 aa, Artificial Sequence
  Description of Artificial Sequence: Synthetic peptide
SISSSSHYIY

SEQ ID NO: 1681 - protein, 15 aa, Artificial Sequence
  Description of Artificial Sequence: Synthetic peptide
DRGVTTDYYYYALDV

SEQ ID NO: 1682 - protein, 11 aa, Artificial Sequence
  Description of Artificial Sequence: Synthetic peptide
RASQGIYNYLA

SEQ ID NO: 1683 - protein, 7 aa, Artificial Sequence
  Description of Artificial Sequence: Synthetic peptide
AASTLQS

SEQ ID NO: 1684 - protein, 9 aa, Artificial Sequence
  Description of Artificial Sequence: Synthetic peptide
QKYNRAPFT

SEQ ID NO: 1685 - protein, 6 aa, Artificial Sequence
  Description of Artificial Sequence: Synthetic peptide
SNYDMN

SEQ ID NO: 1686 - protein, 13 aa, Artificial Sequence
  Description of Artificial Sequence: Synthetic peptide
WVSSISSSSHYIY

SEQ ID NO: 1687 - protein, 16 aa, Artificial Sequence
  Description of Artificial Sequence: Synthetic peptide
ARDRGVTTDYYYYALD

SEQ ID NO: 1688 - protein, 7 aa, Artificial Sequence
  Description of Artificial Sequence: Synthetic peptide
YNYLAWY

SEQ ID NO: 1689 - protein, 10 aa, Artificial Sequence
  Description of Artificial Sequence: Synthetic peptide
LLIYAASTLQ

SEQ ID NO: 1690 - protein, 8 aa, Artificial Sequence
  Description of Artificial Sequence: Synthetic peptide
QKYNRAPF

SEQ ID NO: 1691 - protein, 8 aa, Artificial Sequence
  Description of Artificial Sequence: Synthetic peptide
GFSFSNYD

SEQ ID NO: 1692 - protein, 8 aa, Artificial Sequence
  Description of Artificial Sequence: Synthetic peptide
ISSSSHYI

SEQ ID NO: 1693 - protein, 17 aa, Artificial Sequence
  Description of Artificial Sequence: Synthetic peptide
ARDRGVTTDYYYYALDV

SEQ ID NO: 1694 - protein, 6 aa, Artificial Sequence
  Description of Artificial Sequence: Synthetic peptide
QGIYNY

SEQ ID NO: 1695 - protein, 3 aa, Artificial Sequence
  Description of Artificial Sequence: Synthetic peptide
AAS

SEQ ID NO: 1696 - protein, 9 aa, Artificial Sequence
  Description of Artificial Sequence: Synthetic peptide
QKYNRAPFT

SEQ ID NO: 1697 - protein, 124 aa, Artificial Sequence
  Description of Artificial Sequence: Synthetic polypeptide
EVQLLESGGGLVKPGGSLRLSCAASGFSFSNYDMNWVRQAPRKGLEWVSSISSSSHYIYYADSLKGRFTISRDNAKNSLFLQMNSLRAEDTAVYYCARDRGVTTDYYYYALDVWGQGTMVTVSS

SEQ ID NO: 1698 - protein, 107 aa, Artificial Sequence
  Description of Artificial Sequence: Synthetic polypeptide
DIVMTQSPSSLSASVGDRVTITCRASQGIYNYLAWYQQKPGNVPKLLIYAASTLQSGVPSRFSGSGSGTDFSLTISSLQPEDFTTYYCQKYNRAPFTFGPGTKVDIK

SEQ ID NO: 1699 - protein, 454 aa, Artificial Sequence
  Description of Artificial Sequence: Synthetic polypeptide
EVQLLESGGGLVKPGGSLRLSCAASGFSFSNYDMNWVRQAPRKGLEWVSSISSSSHYIYYADSLKGRFTISRDNAKNSLFLQMNSLRAEDTAVYYCARDRGVTTDYYYYALDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1700 - protein, 214 aa, Artificial Sequence
  Description of Artificial Sequence: Synthetic polypeptide
DIVMTQSPSSLSASVGDRVTITCRASQGIYNYLAWYQQKPGNVPKLLIYAASTLQSGVPSRFSGSGSGTDFSLTISSLQPEDFTTYYCQKYNRAPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1701 - protein, 5 aa, Artificial Sequence
  Description of Artificial Sequence: Synthetic peptide
TYGMH

SEQ ID NO: 1702 - protein, 17 aa, Artificial Sequence
  Description of Artificial Sequence: Synthetic peptide
VIWYNGSNKYYADSVKG

SEQ ID NO: 1703 - protein, 9 aa, Artificial Sequence
  Description of Artificial Sequence: Synthetic peptide
GGFGESFDS

SEQ ID NO: 1704 - protein, 11 aa, Artificial Sequence
  Description of Artificial Sequence: Synthetic peptide
RASQSVIDYLA

SEQ ID NO: 1705 - protein, 7 aa, Artificial Sequence
  Description of Artificial Sequence: Synthetic peptide
DASNRAT

SEQ ID NO: 1706 - protein, 9 aa, Artificial Sequence
  Description of Artificial Sequence: Synthetic peptide
QQRSNWPLT

SEQ ID NO: 1707 - protein, 7 aa, Artificial Sequence
  Description of Artificial Sequence: Synthetic peptide
GFTFGTY

SEQ ID NO: 1708 - protein, 6 aa, Artificial Sequence
  Description of Artificial Sequence: Synthetic peptide
WYNGSN

SEQ ID NO: 1709 - protein, 8 aa, Artificial Sequence
  Description of Artificial Sequence: Synthetic peptide
GGFGESFD

SEQ ID NO: 1710 - protein, 7 aa, Artificial Sequence
  Description of Artificial Sequence: Synthetic peptide
SQSVIDY

SEQ ID NO: 1711 - protein, 3 aa, Artificial Sequence
  Description of Artificial Sequence: Synthetic peptide
DAS

SEQ ID NO: 1712 - protein, 6 aa, Artificial Sequence
  Description of Artificial Sequence: Synthetic peptide
RSNWPL

SEQ ID NO: 1713 - protein, 10 aa, Artificial Sequence
  Description of Artificial Sequence: Synthetic peptide
GFTFGTYGMH

SEQ ID NO: 1714 - protein, 10 aa, Artificial Sequence
  Description of Artificial Sequence: Synthetic peptide
VIWYNGSNKY

SEQ ID NO: 1715 - protein, 9 aa, Artificial Sequence
  Description of Artificial Sequence: Synthetic peptide
GGFGESFDS

SEQ ID NO: 1716 - protein, 11 aa, Artificial Sequence
  Description of Artificial Sequence: Synthetic peptide
RASQSVIDYLA

SEQ ID NO: 1717 - protein, 7 aa, Artificial Sequence
  Description of Artificial Sequence: Synthetic peptide
DASNRAT

SEQ ID NO: 1718 - protein, 9 aa, Artificial Sequence
  Description of Artificial Sequence: Synthetic peptide
QQRSNWPLT

SEQ ID NO: 1719 - protein, 6 aa, Artificial Sequence
  Description of Artificial Sequence: Synthetic peptide
GTYGMH

SEQ ID NO: 1720 - protein, 13 aa, Artificial Sequence
  Description of Artificial Sequence: Synthetic peptide
WVAVIWYNGSNKY

SEQ ID NO: 1721 - protein, 10 aa, Artificial Sequence
  Description of Artificial Sequence: Synthetic peptide
ARGGFGESFD

SEQ ID NO: 1722 - protein, 7 aa, Artificial Sequence
  Description of Artificial Sequence: Synthetic peptide
IDYLAWF

SEQ ID NO: 1723 - protein, 10 aa, Artificial Sequence
  Description of Artificial Sequence: Synthetic peptide
LLIYDASNRA

SEQ ID NO: 1724 - protein, 8 aa, Artificial Sequence
  Description of Artificial Sequence: Synthetic peptide
QQRSNWPL

SEQ ID NO: 1725 - protein, 8 aa, Artificial Sequence
  Description of Artificial Sequence: Synthetic peptide
GFTFGTYG

SEQ ID NO: 1726 - protein, 8 aa, Artificial Sequence
  Description of Artificial Sequence: Synthetic peptide
IWYNGSNK

SEQ ID NO: 1727 - protein, 11 aa, Artificial Sequence
  Description of Artificial Sequence: Synthetic peptide
ARGGFGESFDS

SEQ ID NO: 1728 - protein, 6 aa, Artificial Sequence
  Description of Artificial Sequence: Synthetic peptide
QSVIDY

SEQ ID NO: 1729 - protein, 3 aa, Artificial Sequence
  Description of Artificial Sequence: Synthetic peptide
DAS

SEQ ID NO: 1730 - protein, 9 aa, Artificial Sequence
  Description of Artificial Sequence: Synthetic peptide
QQRSNWPLT

SEQ ID NO: 1731 - protein, 118 aa, Artificial Sequence
  Description of Artificial Sequence: Synthetic polypeptide
EVQLVESGGGVVQPGKSLRLSCTASGFTFGTYGMHWVRQAPGKGLDWVAVIWYNGSNKYYADSVKGRFTISRDNSKNTLYLQMNSLRTEDTAVYYCARGGFGESFDSWGQGTLVTVSS

SEQ ID NO: 1732 - protein, 107 aa, Artificial Sequence
  Description of Artificial Sequence: Synthetic polypeptide
DIVMTQTPATLSLSPGERATLSCRASQSVIDYLAWFQQKPGQAPRLLIYDASNRATGIPARFSGSGSGTDFTLTISSLEPEDFAVYYCQQRSNWPLTFGGGTKVEIK

SEQ ID NO: 1733 - protein, 448 aa, Artificial Sequence
  Description of Artificial Sequence: Synthetic polypeptide
EVQLVESGGGVVQPGKSLRLSCTASGFTFGTYGMHWVRQAPGKGLDWVAVIWYNGSNKYYADSVKGRFTISRDNSKNTLYLQMNSLRTEDTAVYYCARGGFGESFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1734 - protein, 214 aa, Artificial Sequence
  Description of Artificial Sequence: Synthetic polypeptide
DIVMTQTPATLSLSPGERATLSCRASQSVIDYLAWFQQKPGQAPRLLIYDASNRATGIPARFSGSGSGTDFTLTISSLEPEDFAVYYCQQRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1735 - protein, 5 aa, Artificial Sequence
  Description of Artificial Sequence: Synthetic peptide
TYTMN

SEQ ID NO: 1736 - protein, 17 aa, Artificial Sequence
  Description of Artificial Sequence: Synthetic peptide
SISSSSFYMDYADSVKG

SEQ ID NO: 1737 - protein, 14 aa, Artificial Sequence
  Description of Artificial Sequence: Synthetic peptide
DGDIVATIRGSFDY

SEQ ID NO: 1738 - protein, 11 aa, Artificial Sequence
  Description of Artificial Sequence: Synthetic peptide
RASQDITNFLA

SEQ ID NO: 1739 - protein, 7 aa, Artificial Sequence
  Description of Artificial Sequence: Synthetic peptide
TASTLQS

SEQ ID NO: 1740 - protein, 9 aa, Artificial Sequence
  Description of Artificial Sequence: Synthetic peptide
QKYNSAPFT

SEQ ID NO: 1741 - protein, 7 aa, Artificial Sequence
  Description of Artificial Sequence: Synthetic peptide
GFTFSTY

SEQ ID NO: 1742 - protein, 6 aa, Artificial Sequence
  Description of Artificial Sequence: Synthetic peptide
SSSSFY

SEQ ID NO: 1743 - protein, 13 aa, Artificial Sequence
  Description of Artificial Sequence: Synthetic peptide
DGDIVATIRGSFD

SEQ ID NO: 1744 - protein, 7 aa, Artificial Sequence
  Description of Artificial Sequence: Synthetic peptide
SQDITNF

SEQ ID NO: 1745 - protein, 3 aa, Artificial Sequence
  Description of Artificial Sequence: Synthetic peptide
TAS

SEQ ID NO: 1746 - protein, 6 aa, Artificial Sequence
  Description of Artificial Sequence: Synthetic peptide
YNSAPF

SEQ ID NO: 1747 - protein, 10 aa, Artificial Sequence
  Description of Artificial Sequence: Synthetic peptide
GFTFSTYTMN

SEQ ID NO: 1748 - protein, 10 aa, Artificial Sequence
  Description of Artificial Sequence: Synthetic peptide
SISSSSFYMD

SEQ ID NO: 1749 - protein, 14 aa, Artificial Sequence
  Description of Artificial Sequence: Synthetic peptide
DGDIVATIRGSFDY

SEQ ID NO: 1750 - protein, 11 aa, Artificial Sequence
  Description of Artificial Sequence: Synthetic peptide
RASQDITNFLA

SEQ ID NO: 1751 - protein, 7 aa, Artificial Sequence
  Description of Artificial Sequence: Synthetic peptide
TASTLQS

SEQ ID NO: 1752 - protein, 9 aa, Artificial Sequence
  Description of Artificial Sequence: Synthetic peptide
QKYNSAPFT

SEQ ID NO: 1753 - protein, 6 aa, Artificial Sequence
  Description of Artificial Sequence: Synthetic peptide
STYTMN

SEQ ID NO: 1754 - protein, 13 aa, Artificial Sequence
  Description of Artificial Sequence: Synthetic peptide
WVSSISSSSFYMD

SEQ ID NO: 1755 - protein, 15 aa, Artificial Sequence
  Description of Artificial Sequence: Synthetic peptide
ARDGDIVATIRGSFD

SEQ ID NO: 1756 - protein, 7 aa, Artificial Sequence
  Description of Artificial Sequence: Synthetic peptide
TNFLAWY

SEQ ID NO: 1757 - protein, 10 aa, Artificial Sequence
  Description of Artificial Sequence: Synthetic peptide
LLIYTASTLQ

SEQ ID NO: 1758 - protein, 8 aa, Artificial Sequence
  Description of Artificial Sequence: Synthetic peptide
QKYNSAPF

SEQ ID NO: 1759 - protein, 8 aa, Artificial Sequence
  Description of Artificial Sequence: Synthetic peptide
GFTFSTYT

SEQ ID NO: 1760 - protein, 8 aa, Artificial Sequence
  Description of Artificial Sequence: Synthetic peptide
ISSSSFYM

SEQ ID NO: 1761 - protein, 16 aa, Artificial Sequence
  Description of Artificial Sequence: Synthetic peptide
ARDGDIVATIRGSFDY

SEQ ID NO: 1762 - protein, 6 aa, Artificial Sequence
  Description of Artificial Sequence: Synthetic peptide
QDITNF

SEQ ID NO: 1763 - protein, 3 aa, Artificial Sequence
  Description of Artificial Sequence: Synthetic peptide
TAS

SEQ ID NO: 1764 - protein, 9 aa, Artificial Sequence
  Description of Artificial Sequence: Synthetic peptide
QKYNSAPFT

SEQ ID NO: 1765 - protein, 123 aa, Artificial Sequence
  Description of Artificial Sequence: Synthetic polypeptide
EVQLVESGGGLVKPGGSLRLSCAASGFTFSTYTMNWVRQAPGKGLEWVSSISSSSFYMDYADSVKGRFTISRDNAKNSLSLLMNSLRAEDTAVYYCARDGDIVATIRGSFDYWGQGTMVTVSS

SEQ ID NO: 1766 - protein, 107 aa, Artificial Sequence
  Description of Artificial Sequence: Synthetic polypeptide
EIVLTQSPSSLSTSVGDRVTITCRASQDITNFLAWYQQKPGKLPKLLIYTASTLQSGVPSRFSGSASGPDFTLTISSLQPEDVATYYCQKYNSAPFTFGPGTKVEIK

SEQ ID NO: 1767 - protein, 453 aa, Artificial Sequence
  Description of Artificial Sequence: Synthetic polypeptide
EVQLVESGGGLVKPGGSLRLSCAASGFTFSTYTMNWVRQAPGKGLEWVSSISSSSFYMDYADSVKGRFTISRDNAKNSLSLLMNSLRAEDTAVYYCARDGDIVATIRGSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1768 - protein, 214 aa, Artificial Sequence
  Description of Artificial Sequence: Synthetic polypeptide
EIVLTQSPSSLSTSVGDRVTITCRASQDITNFLAWYQQKPGKLPKLLIYTASTLQSGVPSRFSGSASGPDFTLTISSLQPEDVATYYCQKYNSAPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1769 - protein, 5 aa, Artificial Sequence
  Description of Artificial Sequence: Synthetic peptide
RYAMN

SEQ ID NO: 1770 - protein, 17 aa, Artificial Sequence
  Description of Artificial Sequence: Synthetic peptide
FISGTGYTVYYADSVKG

SEQ ID NO: 1771 - protein, 8 aa, Artificial Sequence
  Description of Artificial Sequence: Synthetic peptide
DQEPGFDY

SEQ ID NO: 1772 - protein, 16 aa, Artificial Sequence
  Description of Artificial Sequence: Synthetic peptide
RSGQSLVHSDGNTYLS

SEQ ID NO: 1773 - protein, 7 aa, Artificial Sequence
  Description of Artificial Sequence: Synthetic peptide
KISNRFS

SEQ ID NO: 1774 - protein, 9 aa, Artificial Sequence
  Description of Artificial Sequence: Synthetic peptide
MQATHFPFT

SEQ ID NO: 1775 - protein, 7 aa, Artificial Sequence
  Description of Artificial Sequence: Synthetic peptide
GFTFSRY

SEQ ID NO: 1776 - protein, 6 aa, Artificial Sequence
  Description of Artificial Sequence: Synthetic peptide
SGTGYT

SEQ ID NO: 1777 - protein, 7 aa, Artificial Sequence
  Description of Artificial Sequence: Synthetic peptide
DQEPGFD

SEQ ID NO: 1778 - protein, 12 aa, Artificial Sequence
  Description of Artificial Sequence: Synthetic peptide
GQSLVHSDGNTY

SEQ ID NO: 1779 - protein, 3 aa, Artificial Sequence
  Description of Artificial Sequence: Synthetic peptide
KIS

SEQ ID NO: 1780 - protein, 6 aa, Artificial Sequence
  Description of Artificial Sequence: Synthetic peptide
ATHFPF

SEQ ID NO: 1781 - protein, 10 aa, Artificial Sequence
  Description of Artificial Sequence: Synthetic peptide
GFTFSRYAMN

SEQ ID NO: 1782 - protein, 10 aa, Artificial Sequence
  Description of Artificial Sequence: Synthetic peptide
FISGTGYTVY

SEQ ID NO: 1783 - protein, 8 aa, Artificial Sequence
  Description of Artificial Sequence: Synthetic peptide
DQEPGFDY

SEQ ID NO: 1784 - protein, 16 aa, Artificial Sequence
  Description of Artificial Sequence: Synthetic peptide
RSGQSLVHSDGNTYLS

SEQ ID NO: 1785 - protein, 7 aa, Artificial Sequence
  Description of Artificial Sequence: Synthetic peptide
KISNRFS

SEQ ID NO: 1786 - protein, 9 aa, Artificial Sequence
  Description of Artificial Sequence: Synthetic peptide
MQATHFPFT

SEQ ID NO: 1787 - protein, 6 aa, Artificial Sequence
  Description of Artificial Sequence: Synthetic peptide
SRYAMN

SEQ ID NO: 1788 - protein, 13 aa, Artificial Sequence
  Description of Artificial Sequence: Synthetic peptide
WVSFISGTGYTVY

SEQ ID NO: 1789 - protein, 9 aa, Artificial Sequence
  Description of Artificial Sequence: Synthetic peptide
ARDQEPGFD

SEQ ID NO: 1790 - protein, 12 aa, Artificial Sequence
  Description of Artificial Sequence: Synthetic peptide
VHSDGNTYLSWL

SEQ ID NO: 1791 - protein, 10 aa, Artificial Sequence
  Description of Artificial Sequence: Synthetic peptide
LLIYKISNRF

SEQ ID NO: 1792 - protein, 8 aa, Artificial Sequence
  Description of Artificial Sequence: Synthetic peptide
MQATHFPF

SEQ ID NO: 1793 - protein, 8 aa, Artificial Sequence
  Description of Artificial Sequence: Synthetic peptide
GFTFSRYA

SEQ ID NO: 1794 - protein, 8 aa, Artificial Sequence
  Description of Artificial Sequence: Synthetic peptide
ISGTGYTV

SEQ ID NO: 1795 - protein, 10 aa, Artificial Sequence
  Description of Artificial Sequence: Synthetic peptide
ARDQEPGFDY

SEQ ID NO: 1796 - protein, 11 aa, Artificial Sequence
  Description of Artificial Sequence: Synthetic peptide
QSLVHSDGNTY

SEQ ID NO: 1797 - protein, 3 aa, Artificial Sequence
  Description of Artificial Sequence: Synthetic peptide
KIS

SEQ ID NO: 1798 - protein, 9 aa, Artificial Sequence
  Description of Artificial Sequence: Synthetic peptide
MQATHFPFT

SEQ ID NO: 1799 - protein, 117 aa, Artificial Sequence
  Description of Artificial Sequence: Synthetic polypeptide
EVQLVQSGGDLLQPGGSLRLSCAASGFTFSRYAMNWVRQAPGKGLEWVSFISGTGYTVYYADSVKGRFTISRDNAKNSLYLQMNSLRDEDTAVYYCARDQEPGFDYWGQGTLVTVSS

SEQ ID NO: 1800 - protein, 112 aa, Artificial Sequence
  Description of Artificial Sequence: Synthetic polypeptide
DIVMTQTPLSSPVTLGQPASISCRSGQSLVHSDGNTYLSWLQQRPGQPPRLLIYKISNRFSGVPDRFSGSGAGTDFTLKISRVEAEDVGVYYCMQATHFPFTFGQGTKLEIK

SEQ ID NO: 1801 - protein, 447 aa, Artificial Sequence
  Description of Artificial Sequence: Synthetic polypeptide
EVQLVQSGGDLLQPGGSLRLSCAASGFTFSRYAMNWVRQAPGKGLEWVSFISGTGYTVYYADSVKGRFTISRDNAKNSLYLQMNSLRDEDTAVYYCARDQEPGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1802 - protein, 219 aa, Artificial Sequence
  Description of Artificial Sequence: Synthetic polypeptide
DIVMTQTPLSSPVTLGQPASISCRSGQSLVHSDGNTYLSWLQQRPGQPPRLLIYKISNRFSGVPDRFSGSGAGTDFTLKISRVEAEDVGVYYCMQATHFPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1803 - protein, 5 aa, Artificial Sequence
  Description of Artificial Sequence: Synthetic peptide
SHDMN

SEQ ID NO: 1804 - protein, 17 aa, Artificial Sequence
  Description of Artificial Sequence: Synthetic peptide
SISSSSSYIFYADSVKG

SEQ ID NO: 1805 - protein, 16 aa, Artificial Sequence
  Description of Artificial Sequence: Synthetic peptide
DLGVGVRDYYYYGMDV

SEQ ID NO: 1806 - protein, 11 aa, Artificial Sequence
  Description of Artificial Sequence: Synthetic peptide
RASQDITNYLA

SEQ ID NO: 1807 - protein, 7 aa, Artificial Sequence
  Description of Artificial Sequence: Synthetic peptide
AASSLQG

SEQ ID NO: 1808 - protein, 9 aa, Artificial Sequence
  Description of Artificial Sequence: Synthetic peptide
LQHDTYPYT

SEQ ID NO: 1809 - protein, 7 aa, Artificial Sequence
  Description of Artificial Sequence: Synthetic peptide
GFTFSSH

SEQ ID NO: 1810 - protein, 6 aa, Artificial Sequence
  Description of Artificial Sequence: Synthetic peptide
SSSSSY

SEQ ID NO: 1811 - protein, 15 aa, Artificial Sequence
  Description of Artificial Sequence: Synthetic peptide
DLGVGVRDYYYYGMD

SEQ ID NO: 1812 - protein, 7 aa, Artificial Sequence
  Description of Artificial Sequence: Synthetic peptide
SQDITNY

SEQ ID NO: 1813 - protein, 3 aa, Artificial Sequence
  Description of Artificial Sequence: Synthetic peptide
AAS

SEQ ID NO: 1814 - protein, 6 aa, Artificial Sequence
  Description of Artificial Sequence: Synthetic peptide
HDTYPY

SEQ ID NO: 1815 - protein, 10 aa, Artificial Sequence
  Description of Artificial Sequence: Synthetic peptide
GFTFSSHDMN

SEQ ID NO: 1816 - protein, 10 aa, Artificial Sequence
  Description of Artificial Sequence: Synthetic peptide
SISSSSSYIF

SEQ ID NO: 1817 - protein, 16 aa, Artificial Sequence
  Description of Artificial Sequence: Synthetic peptide
DLGVGVRDYYYYGMDV

SEQ ID NO: 1818 - protein, 11 aa, Artificial Sequence
  Description of Artificial Sequence: Synthetic peptide
RASQDITNYLA

SEQ ID NO: 1819 - protein, 7 aa, Artificial Sequence
  Description of Artificial Sequence: Synthetic peptide
AASSLQG

SEQ ID NO: 1820 - protein, 9 aa, Artificial Sequence
  Description of Artificial Sequence: Synthetic peptide
LQHDTYPYT

SEQ ID NO: 1821 - protein, 6 aa, Artificial Sequence
  Description of Artificial Sequence: Synthetic peptide
SSHDMN

SEQ ID NO: 1822 - protein, 13 aa, Artificial Sequence
  Description of Artificial Sequence: Synthetic peptide
WVSSISSSSSYIF

SEQ ID NO: 1823 - protein, 17 aa, Artificial Sequence
  Description of Artificial Sequence: Synthetic peptide
ARDLGVGVRDYYYYGMD

SEQ ID NO: 1824 - protein, 7 aa, Artificial Sequence
  Description of Artificial Sequence: Synthetic peptide
TNYLAWF

SEQ ID NO: 1825 - protein, 10 aa, Artificial Sequence
  Description of Artificial Sequence: Synthetic peptide
RLIYAASSLQ

SEQ ID NO: 1826 - protein, 8 aa, Artificial Sequence
  Description of Artificial Sequence: Synthetic peptide
LQHDTYPY

SEQ ID NO: 1827 - protein, 8 aa, Artificial Sequence
  Description of Artificial Sequence: Synthetic peptide
GFTFSSHD

SEQ ID NO: 1828 - protein, 8 aa, Artificial Sequence
  Description of Artificial Sequence: Synthetic peptide
ISSSSSYI

SEQ ID NO: 1829 - protein, 18 aa, Artificial Sequence
  Description of Artificial Sequence: Synthetic peptide
ARDLGVGVRDYYYYGMDV

SEQ ID NO: 1830 - protein, 6 aa, Artificial Sequence
  Description of Artificial Sequence: Synthetic peptide
QDITNY

SEQ ID NO: 1831 - protein, 3 aa, Artificial Sequence
  Description of Artificial Sequence: Synthetic peptide
AAS

SEQ ID NO: 1832 - protein, 9 aa, Artificial Sequence
  Description of Artificial Sequence: Synthetic peptide
LQHDTYPYT

SEQ ID NO: 1833 - protein, 125 aa, Artificial Sequence
  Description of Artificial Sequence: Synthetic polypeptide
EVQLVESGGGLVKPGGSLRLSCAASGFTFSSHDMNWVRQAPGKGLGWVSSISSSSSYIFYADSVKGRFTISRDNAKNSLYLQMSSLRAEDTAVYYCARDLGVGVRDYYYYGMDVWGQGTMVTVSS

SEQ ID NO: 1834 - protein, 107 aa, Artificial Sequence
  Description of Artificial Sequence: Synthetic polypeptide
DIQMTQSPSAMSASVGDRVTITCRASQDITNYLAWFQQKPGKVPKRLIYAASSLQGGVPSRFSGSGSGTEFTLTISSLQPEDFSTYYCLQHDTYPYTFGQGTKLEIK

SEQ ID NO: 1835 - protein, 455 aa, Artificial Sequence
  Description of Artificial Sequence: Synthetic polypeptide
EVQLVESGGGLVKPGGSLRLSCAASGFTFSSHDMNWVRQAPGKGLGWVSSISSSSSYIFYADSVKGRFTISRDNAKNSLYLQMSSLRAEDTAVYYCARDLGVGVRDYYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1836 - protein, 214 aa, Artificial Sequence
  Description of Artificial Sequence: Synthetic polypeptide
DIQMTQSPSAMSASVGDRVTITCRASQDITNYLAWFQQKPGKVPKRLIYAASSLQGGVPSRFSGSGSGTEFTLTISSLQPEDFSTYYCLQHDTYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1837 - protein, 7 aa, Artificial Sequence
  Description of Artificial Sequence: Synthetic peptide
TYGVGVG

SEQ ID NO: 1838 - protein, 16 aa, Artificial Sequence
  Description of Artificial Sequence: Synthetic peptide
LIYWNDDKRYYPSLNN

SEQ ID NO: 1839 - protein, 11 aa, Artificial Sequence
  Description of Artificial Sequence: Synthetic peptide
DYDFWSGYFDY

SEQ ID NO: 1840 - protein, 12 aa, Artificial Sequence
  Description of Artificial Sequence: Synthetic peptide
RASQSVSSSYLA

SEQ ID NO: 1841 - protein, 7 aa, Artificial Sequence
  Description of Artificial Sequence: Synthetic peptide
GASSRAT

SEQ ID NO: 1842 - protein, 9 aa, Artificial Sequence
  Description of Artificial Sequence: Synthetic peptide
QQYGSSPLT

SEQ ID NO: 1843 - protein, 9 aa, Artificial Sequence
  Description of Artificial Sequence: Synthetic peptide
GFSLTTYGV

SEQ ID NO: 1844 - protein, 5 aa, Artificial Sequence
  Description of Artificial Sequence: Synthetic peptide
YWNDD

SEQ ID NO: 1845 - protein, 10 aa, Artificial Sequence
  Description of Artificial Sequence: Synthetic peptide
DYDFWSGYFD

SEQ ID NO: 1846 - protein, 8 aa, Artificial Sequence
  Description of Artificial Sequence: Synthetic peptide
SQSVSSSY

SEQ ID NO: 1847 - protein, 3 aa, Artificial Sequence
  Description of Artificial Sequence: Synthetic peptide
GAS

SEQ ID NO: 1848 - protein, 6 aa, Artificial Sequence
  Description of Artificial Sequence: Synthetic peptide
YGSSPL

SEQ ID NO: 1849 - protein, 12 aa, Artificial Sequence
  Description of Artificial Sequence: Synthetic peptide
GFSLTTYGVGVG

SEQ ID NO: 1850 - protein, 9 aa, Artificial Sequence
  Description of Artificial Sequence: Synthetic peptide
LIYWNDDKR

SEQ ID NO: 1851 - protein, 11 aa, Artificial Sequence
  Description of Artificial Sequence: Synthetic peptide
DYDFWSGYFDY

SEQ ID NO: 1852 - protein, 12 aa, Artificial Sequence
  Description of Artificial Sequence: Synthetic peptide
RASQSVSSSYLA

SEQ ID NO: 1853 - protein, 7 aa, Artificial Sequence
  Description of Artificial Sequence: Synthetic peptide
GASSRAT

SEQ ID NO: 1854 - protein, 9 aa, Artificial Sequence
  Description of Artificial Sequence: Synthetic peptide
QQYGSSPLT

SEQ ID NO: 1855 - protein, 8 aa, Artificial Sequence
  Description of Artificial Sequence: Synthetic peptide
TTYGVGVG

SEQ ID NO: 1856 - protein, 12 aa, Artificial Sequence
  Description of Artificial Sequence: Synthetic peptide
WLALIYWNDDKR

SEQ ID NO: 1857 - protein, 12 aa, Artificial Sequence
  Description of Artificial Sequence: Synthetic peptide
AHDYDFWSGYFD

SEQ ID NO: 1858 - protein, 8 aa, Artificial Sequence
  Description of Artificial Sequence: Synthetic peptide
SSSYLAWY

SEQ ID NO: 1859 - protein, 10 aa, Artificial Sequence
  Description of Artificial Sequence: Synthetic peptide
LLIYGASSRA

SEQ ID NO: 1860 - protein, 8 aa, Artificial Sequence
  Description of Artificial Sequence: Synthetic peptide
QQYGSSPL

SEQ ID NO: 1861 - protein, 10 aa, Artificial Sequence
  Description of Artificial Sequence: Synthetic peptide
GFSLTTYGVG

SEQ ID NO: 1862 - protein, 7 aa, Artificial Sequence
  Description of Artificial Sequence: Synthetic peptide
IYWNDDK

SEQ ID NO: 1863 - protein, 13 aa, Artificial Sequence
  Description of Artificial Sequence: Synthetic peptide
AHDYDFWSGYFDY

SEQ ID NO: 1864 - protein, 7 aa, Artificial Sequence
  Description of Artificial Sequence: Synthetic peptide
QSVSSSY

SEQ ID NO: 1865 - protein, 3 aa, Artificial Sequence
  Description of Artificial Sequence: Synthetic peptide
GAS

SEQ ID NO: 1866 - protein, 9 aa, Artificial Sequence
  Description of Artificial Sequence: Synthetic peptide
QQYGSSPLT

SEQ ID NO: 1867 - protein, 121 aa, Artificial Sequence
  Description of Artificial Sequence: Synthetic polypeptide
QVTLKESGPTLVTPSQTLTLTCTFSGFSLTTYGVGVGWIRQPPGKALEWLALIYWNDDKRYYPSLNNRLTITKDTSKHLVVLTLTNMDPVDTATYYCAHDYDFWSGYFDYWGQGTLVTVSS

SEQ ID NO: 1868 - protein, 108 aa, Artificial Sequence
  Description of Artificial Sequence: Synthetic polypeptide
DIVMTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 1869 - protein, 451 aa, Artificial Sequence
  Description of Artificial Sequence: Synthetic polypeptide
QVTLKESGPTLVTPSQTLTLTCTFSGFSLTTYGVGVGWIRQPPGKALEWLALIYWNDDKRYYPSLNNRLTITKDTSKHLVVLTLTNMDPVDTATYYCAHDYDFWSGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1870 - protein, 215 aa, Artificial Sequence
  Description of Artificial Sequence: Synthetic polypeptide
DIVMTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1871 - protein, 5 aa, Artificial Sequence
  Description of Artificial Sequence: Synthetic peptide
GYYMH

SEQ ID NO: 1872 - protein, 17 aa, Artificial Sequence
  Description of Artificial Sequence: Synthetic peptide
RINPNSGVTHYAQKFQG

SEQ ID NO: 1873 - protein, 14 aa, Artificial Sequence
  Description of Artificial Sequence: Synthetic peptide
GGSLVRGVISGLDY

SEQ ID NO: 1874 - protein, 12 aa, Artificial Sequence
  Description of Artificial Sequence: Synthetic peptide
RASQSFSGSYLA

SEQ ID NO: 1875 - protein, 7 aa, Artificial Sequence
  Description of Artificial Sequence: Synthetic peptide
GASSRAT

SEQ ID NO: 1876 - protein, 10 aa, Artificial Sequence
  Description of Artificial Sequence: Synthetic peptide
QQYGSSPPYT

SEQ ID NO: 1877 - protein, 7 aa, Artificial Sequence
  Description of Artificial Sequence: Synthetic peptide
GYTFTGY

SEQ ID NO: 1878 - protein, 6 aa, Artificial Sequence
  Description of Artificial Sequence: Synthetic peptide
NPNSGV

SEQ ID NO: 1879 - protein, 13 aa, Artificial Sequence
  Description of Artificial Sequence: Synthetic peptide
GGSLVRGVISGLD

SEQ ID NO: 1880 - protein, 8 aa, Artificial Sequence
  Description of Artificial Sequence: Synthetic peptide
SQSFSGSY

SEQ ID NO: 1881 - protein, 3 aa, Artificial Sequence
  Description of Artificial Sequence: Synthetic peptide
GAS

SEQ ID NO: 1882 - protein, 7 aa, Artificial Sequence
  Description of Artificial Sequence: Synthetic peptide
YGSSPPY

SEQ ID NO: 1883 - protein, 10 aa, Artificial Sequence
  Description of Artificial Sequence: Synthetic peptide
GYTFTGYYMH

SEQ ID NO: 1884 - protein, 10 aa, Artificial Sequence
  Description of Artificial Sequence: Synthetic peptide
RINPNSGVTH

SEQ ID NO: 1885 - protein, 14 aa, Artificial Sequence
  Description of Artificial Sequence: Synthetic peptide
GGSLVRGVISGLDY

SEQ ID NO: 1886 - protein, 12 aa, Artificial Sequence
  Description of Artificial Sequence: Synthetic peptide
RASQSFSGSYLA

SEQ ID NO: 1887 - protein, 7 aa, Artificial Sequence
  Description of Artificial Sequence: Synthetic peptide
GASSRAT

SEQ ID NO: 1888 - protein, 10 aa, Artificial Sequence
  Description of Artificial Sequence: Synthetic peptide
QQYGSSPPYT

SEQ ID NO: 1889 - protein, 6 aa, Artificial Sequence
  Description of Artificial Sequence: Synthetic peptide
TGYYMH

SEQ ID NO: 1890 - protein, 13 aa, Artificial Sequence
  Description of Artificial Sequence: Synthetic peptide
WMGRINPNSGVTH

SEQ ID NO: 1891 - protein, 15 aa, Artificial Sequence
  Description of Artificial Sequence: Synthetic peptide
ARGGSLVRGVISGLD

SEQ ID NO: 1892 - protein, 8 aa, Artificial Sequence
  Description of Artificial Sequence: Synthetic peptide
SGSYLAWY

SEQ ID NO: 1893 - protein, 10 aa, Artificial Sequence
  Description of Artificial Sequence: Synthetic peptide
LLIYGASSRA

SEQ ID NO: 1894 - protein, 9 aa, Artificial Sequence
  Description of Artificial Sequence: Synthetic peptide
QQYGSSPPY

SEQ ID NO: 1895 - protein, 8 aa, Artificial Sequence
  Description of Artificial Sequence: Synthetic peptide
GYTFTGYY

SEQ ID NO: 1896 - protein, 8 aa, Artificial Sequence
  Description of Artificial Sequence: Synthetic peptide
INPNSGVT

SEQ ID NO: 1897 - protein, 16 aa, Artificial Sequence
  Description of Artificial Sequence: Synthetic peptide
ARGGSLVRGVISGLDY

SEQ ID NO: 1898 - protein, 7 aa, Artificial Sequence
  Description of Artificial Sequence: Synthetic peptide
QSFSGSY

SEQ ID NO: 1899 - protein, 3 aa, Artificial Sequence
  Description of Artificial Sequence: Synthetic peptide
GAS

SEQ ID NO: 1900 - protein, 10 aa, Artificial Sequence
  Description of Artificial Sequence: Synthetic peptide
QQYGSSPPYT

SEQ ID NO: 1901 - protein, 123 aa, Artificial Sequence
  Description of Artificial Sequence: Synthetic polypeptide
QVQLVQSGAEVKKPGASVKVSCKASGYTFTGYYMHWVRQAPGQGLEWMGRINPNSGVTHYAQKFQGRVTMTRDTSISTAYMELSRLRSDDTAVYYCARGGSLVRGVISGLDYWGQGTTVTVSS

SEQ ID NO: 1902 - protein, 109 aa, Artificial Sequence
  Description of Artificial Sequence: Synthetic polypeptide
DIVMTQSPGTLSLSPGERATLSCRASQSFSGSYLAWYQQKPGQAPSLLIYGASSRATGIPDRFSGSGSGTDFTLTISRLEPEDFALYYCQQYGSSPPYTFGQGTKVEIK

SEQ ID NO: 1903 - protein, 453 aa, Artificial Sequence
  Description of Artificial Sequence: Synthetic polypeptide
QVQLVQSGAEVKKPGASVKVSCKASGYTFTGYYMHWVRQAPGQGLEWMGRINPNSGVTHYAQKFQGRVTMTRDTSISTAYMELSRLRSDDTAVYYCARGGSLVRGVISGLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1904 - protein, 216 aa, Artificial Sequence
  Description of Artificial Sequence: Synthetic polypeptide
DIVMTQSPGTLSLSPGERATLSCRASQSFSGSYLAWYQQKPGQAPSLLIYGASSRATGIPDRFSGSGSGTDFTLTISRLEPEDFALYYCQQYGSSPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1905 - protein, 5 aa, Artificial Sequence
  Description of Artificial Sequence: Synthetic peptide
SYYMH

SEQ ID NO: 1906 - protein, 17 aa, Artificial Sequence
  Description of Artificial Sequence: Synthetic peptide
IINPSGGSTSYAQKFQG

SEQ ID NO: 1907 - protein, 9 aa, Artificial Sequence
  Description of Artificial Sequence: Synthetic peptide
GSYGWYFDL

SEQ ID NO: 1908 - protein, 12 aa, Artificial Sequence
  Description of Artificial Sequence: Synthetic peptide
RASQSVTSSYLA

SEQ ID NO: 1909 - protein, 7 aa, Artificial Sequence
  Description of Artificial Sequence: Synthetic peptide
GASSRAT

SEQ ID NO: 1910 - protein, 10 aa, Artificial Sequence
  Description of Artificial Sequence: Synthetic peptide
QQYGSSPPYT

SEQ ID NO: 1911 - protein, 7 aa, Artificial Sequence
  Description of Artificial Sequence: Synthetic peptide
GYTLTSY

SEQ ID NO: 1912 - protein, 6 aa, Artificial Sequence
  Description of Artificial Sequence: Synthetic peptide
NPSGGS

SEQ ID NO: 1913 - protein, 8 aa, Artificial Sequence
  Description of Artificial Sequence: Synthetic peptide
GSYGWYFD

SEQ ID NO: 1914 - protein, 8 aa, Artificial Sequence
  Description of Artificial Sequence: Synthetic peptide
SQSVTSSY

SEQ ID NO: 1915 - protein, 3 aa, Artificial Sequence
  Description of Artificial Sequence: Synthetic peptide
GAS

SEQ ID NO: 1916 - protein, 7 aa, Artificial Sequence
  Description of Artificial Sequence: Synthetic peptide
YGSSPPY

SEQ ID NO: 1917 - protein, 10 aa, Artificial Sequence
  Description of Artificial Sequence: Synthetic peptide
GYTLTSYYMH

SEQ ID NO: 1918 - protein, 10 aa, Artificial Sequence
  Description of Artificial Sequence: Synthetic peptide
IINPSGGSTS

SEQ ID NO: 1919 - protein, 9 aa, Artificial Sequence
  Description of Artificial Sequence: Synthetic peptide
GSYGWYFDL

SEQ ID NO: 1920 - protein, 12 aa, Artificial Sequence
  Description of Artificial Sequence: Synthetic peptide
RASQSVTSSYLA

SEQ ID NO: 1921 - protein, 7 aa, Artificial Sequence
  Description of Artificial Sequence: Synthetic peptide
GASSRAT

SEQ ID NO: 1922 - protein, 10 aa, Artificial Sequence
  Description of Artificial Sequence: Synthetic peptide
QQYGSSPPYT

SEQ ID NO: 1923 - protein, 6 aa, Artificial Sequence
  Description of Artificial Sequence: Synthetic peptide
TSYYMH

SEQ ID NO: 1924 - protein, 13 aa, Artificial Sequence
  Description of Artificial Sequence: Synthetic peptide
WMGIINPSGGSTS

SEQ ID NO: 1925 - protein, 10 aa, Artificial Sequence
  Description of Artificial Sequence: Synthetic peptide
ARGSYGWYFD

SEQ ID NO: 1926 - protein, 8 aa, Artificial Sequence
  Description of Artificial Sequence: Synthetic peptide
TSSYLAWY

SEQ ID NO: 1927 - protein, 10 aa, Artificial Sequence
  Description of Artificial Sequence: Synthetic peptide
LLIYGASSRA

SEQ ID NO: 1928 - protein, 9 aa, Artificial Sequence
  Description of Artificial Sequence: Synthetic peptide
QQYGSSPPY

SEQ ID NO: 1929 - protein, 8 aa, Artificial Sequence
  Description of Artificial Sequence: Synthetic peptide
GYTLTSYY

SEQ ID NO: 1930 - protein, 8 aa, Artificial Sequence
  Description of Artificial Sequence: Synthetic peptide
INPSGGST

SEQ ID NO: 1931 - protein, 11 aa, Artificial Sequence
  Description of Artificial Sequence: Synthetic peptide
ARGSYGWYFDL

SEQ ID NO: 1932 - protein, 7 aa, Artificial Sequence
  Description of Artificial Sequence: Synthetic peptide
QSVTSSY

SEQ ID NO: 1933 - protein, 3 aa, Artificial Sequence
  Description of Artificial Sequence: Synthetic peptide
GAS

SEQ ID NO: 1934 - protein, 10 aa, Artificial Sequence
  Description of Artificial Sequence: Synthetic peptide
QQYGSSPPYT

SEQ ID NO: 1935 - protein, 118 aa, Artificial Sequence
  Description of Artificial Sequence: Synthetic polypeptide
EVQLVESGAEVKKPGASVKVSCKASGYTLTSYYMHWVRQAPGQGLEWMGIINPSGGSTSYAQKFQGRVTMTRDTSTSTVYMELSSLRSEDTAVYYCARGSYGWYFDLWGRGTLVTVSS

SEQ ID NO: 1936 - protein, 109 aa, Artificial Sequence
  Description of Artificial Sequence: Synthetic polypeptide
EIVLTQSPGTLSLSPGERATLSCRASQSVTSSYLAWYQQKPGQTPRLLIYGASSRATGIPDRISGSGSGTDFTLTVSRLEPEDFAVYYCQQYGSSPPYTFGQGTKLEIK

SEQ ID NO: 1937 - protein, 448 aa, Artificial Sequence
  Description of Artificial Sequence: Synthetic polypeptide
EVQLVESGAEVKKPGASVKVSCKASGYTLTSYYMHWVRQAPGQGLEWMGIINPSGGSTSYAQKFQGRVTMTRDTSTSTVYMELSSLRSEDTAVYYCARGSYGWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1938 - protein, 216 aa, Artificial Sequence
  Description of Artificial Sequence: Synthetic polypeptide
EIVLTQSPGTLSLSPGERATLSCRASQSVTSSYLAWYQQKPGQTPRLLIYGASSRATGIPDRISGSGSGTDFTLTVSRLEPEDFAVYYCQQYGSSPPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1939 - protein, 5 aa, Artificial Sequence
  Description of Artificial Sequence: Synthetic peptide
NYDMN

SEQ ID NO: 1940 - protein, 17 aa, Artificial Sequence
  Description of Artificial Sequence: Synthetic peptide
SISSSSSYIYYADSVKG

SEQ ID NO: 1941 - protein, 15 aa, Artificial Sequence
  Description of Artificial Sequence: Synthetic peptide
DVGVTTDYYYYGMDV

SEQ ID NO: 1942 - protein, 11 aa, Artificial Sequence
  Description of Artificial Sequence: Synthetic peptide
RASQGINSWLA

SEQ ID NO: 1943 - protein, 7 aa, Artificial Sequence
  Description of Artificial Sequence: Synthetic peptide
AASTLQS

SEQ ID NO: 1944 - protein, 9 aa, Artificial Sequence
  Description of Artificial Sequence: Synthetic peptide
QQYNNWPRT

SEQ ID NO: 1945 - protein, 7 aa, Artificial Sequence
  Description of Artificial Sequence: Synthetic peptide
GFTFSNY

SEQ ID NO: 1946 - protein, 6 aa, Artificial Sequence
  Description of Artificial Sequence: Synthetic peptide
SSSSSY

SEQ ID NO: 1947 - protein, 14 aa, Artificial Sequence
  Description of Artificial Sequence: Synthetic peptide
DVGVTTDYYYYGMD

SEQ ID NO: 1948 - protein, 7 aa, Artificial Sequence
  Description of Artificial Sequence: Synthetic peptide
SQGINSW

SEQ ID NO: 1949 - protein, 3 aa, Artificial Sequence
  Description of Artificial Sequence: Synthetic peptide
AAS

SEQ ID NO: 1950 - protein, 6 aa, Artificial Sequence
  Description of Artificial Sequence: Synthetic peptide
YNNWPR

SEQ ID NO: 1951 - protein, 10 aa, Artificial Sequence
  Description of Artificial Sequence: Synthetic peptide
GFTFSNYDMN

SEQ ID NO: 1952 - protein, 10 aa, Artificial Sequence
  Description of Artificial Sequence: Synthetic peptide
SISSSSSYIY

SEQ ID NO: 1953 - protein, 15 aa, Artificial Sequence
  Description of Artificial Sequence: Synthetic peptide
DVGVTTDYYYYGMDV

SEQ ID NO: 1954 - protein, 11 aa, Artificial Sequence
  Description of Artificial Sequence: Synthetic peptide
RASQGINSWLA

SEQ ID NO: 1955 - protein, 7 aa, Artificial Sequence
  Description of Artificial Sequence: Synthetic peptide
AASTLQS

SEQ ID NO: 1956 - protein, 9 aa, Artificial Sequence
  Description of Artificial Sequence: Synthetic peptide
QQYNNWPRT

SEQ ID NO: 1957 - protein, 6 aa, Artificial Sequence
  Description of Artificial Sequence: Synthetic peptide
SNYDMN

SEQ ID NO: 1958 - protein, 13 aa, Artificial Sequence
  Description of Artificial Sequence: Synthetic peptide
WVSSISSSSSYIY

SEQ ID NO: 1959 - protein, 16 aa, Artificial Sequence
  Description of Artificial Sequence: Synthetic peptide
ARDVGVTTDYYYYGMD

SEQ ID NO: 1960 - protein, 7 aa, Artificial Sequence
  Description of Artificial Sequence: Synthetic peptide
NSWLAWY

SEQ ID NO: 1961 - protein, 10 aa, Artificial Sequence
  Description of Artificial Sequence: Synthetic peptide
LLIYAASTLQ

SEQ ID NO: 1962 - protein, 8 aa, Artificial Sequence
  Description of Artificial Sequence: Synthetic peptide
QQYNNWPR

SEQ ID NO: 1963 - protein, 8 aa, Artificial Sequence
  Description of Artificial Sequence: Synthetic peptide
GFTFSNYD

SEQ ID NO: 1964 - protein, 8 aa, Artificial Sequence
  Description of Artificial Sequence: Synthetic peptide
ISSSSSYI

SEQ ID NO: 1965 - protein, 17 aa, Artificial Sequence
  Description of Artificial Sequence: Synthetic peptide
ARDVGVTTDYYYYGMDV

SEQ ID NO: 1966 - protein, 6 aa, Artificial Sequence
  Description of Artificial Sequence: Synthetic peptide
QGINSW

SEQ ID NO: 1967 - protein, 3 aa, Artificial Sequence
  Description of Artificial Sequence: Synthetic peptide
AAS

SEQ ID NO: 1968 - protein, 9 aa, Artificial Sequence
  Description of Artificial Sequence: Synthetic peptide
QQYNNWPRT

SEQ ID NO: 1969 - protein, 124 aa, Artificial Sequence; identical to SEQ ID NO: 371
  Description of Artificial Sequence: Synthetic polypeptide

SEQ ID NO: 1970 - protein, 107 aa, Artificial Sequence
  Description of Artificial Sequence: Synthetic polypeptide
EIVMTQSPSSVSASVGDRVTITCRASQGINSWLAWYQQDPYKAPKLLIYAASTLQSGVPSRFGGRGSGTEFTLTISSLQPEDFAVYYCQQYNNWPRTFGQGTKVDIK

SEQ ID NO: 1971 - protein, 454 aa, Artificial Sequence; identical to SEQ ID NO: 373
  Description of Artificial Sequence: Synthetic polypeptide

SEQ ID NO: 1972 - protein, 214 aa, Artificial Sequence
  Description of Artificial Sequence: Synthetic polypeptide
EIVMTQSPSSVSASVGDRVTITCRASQGINSWLAWYQQDPYKAPKLLIYAASTLQSGVPSRFGGRGSGTEFTLTISSLQPEDFAVYYCQQYNNWPRTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1973 - protein, 5 aa, Artificial Sequence
  Description of Artificial Sequence: Synthetic peptide
SYVIS

SEQ ID NO: 1974 - protein, 17 aa, Artificial Sequence
  Description of Artificial Sequence: Synthetic peptide
GILPILSTANYAQKFQG

SEQ ID NO: 1975 - protein, 10 aa, Artificial Sequence
  Description of Artificial Sequence: Synthetic peptide
AHDYYYGMDV

SEQ ID NO: 1976 - protein, 12 aa, Artificial Sequence
  Description of Artificial Sequence: Synthetic peptide
RASQSVSNNYLA

SEQ ID NO: 1977 - protein, 7 aa, Artificial Sequence
  Description of Artificial Sequence: Synthetic peptide
GASSRAT

SEQ ID NO: 1978 - protein, 10 aa, Artificial Sequence
  Description of Artificial Sequence: Synthetic peptide
QQYGSSPPYT

SEQ ID NO: 1979 - protein, 7 aa, Artificial Sequence
  Description of Artificial Sequence: Synthetic peptide
GGTFSSY

SEQ ID NO: 1980 - protein, 6 aa, Artificial Sequence
  Description of Artificial Sequence: Synthetic peptide
LPILST

SEQ ID NO: 1981 - protein, 9 aa, Artificial Sequence
  Description of Artificial Sequence: Synthetic peptide
AHDYYYGMD

SEQ ID NO: 1982 - protein, 8 aa, Artificial Sequence
  Description of Artificial Sequence: Synthetic peptide
SQSVSNNY

SEQ ID NO: 1983 - protein, 3 aa, Artificial Sequence
  Description of Artificial Sequence: Synthetic peptide
GAS

SEQ ID NO: 1984 - protein, 7 aa, Artificial Sequence
  Description of Artificial Sequence: Synthetic peptide
YGSSPPY

SEQ ID NO: 1985 - protein, 10 aa, Artificial Sequence
  Description of Artificial Sequence: Synthetic peptide
GGTFSSYVIS

SEQ ID NO: 1986 - protein, 10 aa, Artificial Sequence
  Description of Artificial Sequence: Synthetic peptide
GILPILSTAN

SEQ ID NO: 1987 - protein, 10 aa, Artificial Sequence
  Description of Artificial Sequence: Synthetic peptide
AHDYYYGMDV

SEQ ID NO: 1988 - protein, 12 aa, Artificial Sequence
  Description of Artificial Sequence: Synthetic peptide
RASQSVSNNYLA

SEQ ID NO: 1989 - protein, 7 aa, Artificial Sequence
  Description of Artificial Sequence: Synthetic peptide
GASSRAT

SEQ ID NO: 1990 - protein, 10 aa, Artificial Sequence
  Description of Artificial Sequence: Synthetic peptide
QQYGSSPPYT

SEQ ID NO: 1991 - protein, 6 aa, Artificial Sequence
  Description of Artificial Sequence: Synthetic peptide
SSYVIS

SEQ ID NO: 1992 - protein, 13 aa, Artificial Sequence
  Description of Artificial Sequence: Synthetic peptide
WMGGILPILSTAN

SEQ ID NO: 1993 - protein, 11 aa, Artificial Sequence
  Description of Artificial Sequence: Synthetic peptide
ARAHDYYYGMD

SEQ ID NO: 1994 - protein, 8 aa, Artificial Sequence
  Description of Artificial Sequence: Synthetic peptide
SNNYLAWY

SEQ ID NO: 1995 - protein, 10 aa, Artificial Sequence
  Description of Artificial Sequence: Synthetic peptide
LLIYGASSRA

SEQ ID NO: 1996 - protein, 9 aa, Artificial Sequence
  Description of Artificial Sequence: Synthetic peptide
QQYGSSPPY

SEQ ID NO: 1997 - protein, 8 aa, Artificial Sequence
  Description of Artificial Sequence: Synthetic peptide
GGTFSSYV

SEQ ID NO: 1998 - protein, 8 aa, Artificial Sequence
  Description of Artificial Sequence: Synthetic peptide
ILPILSTA

SEQ ID NO: 1999 - protein, 12 aa, Artificial Sequence
  Description of Artificial Sequence: Synthetic peptide
ARAHDYYYGMDV

SEQ ID NO: 2000 - protein, 7 aa, Artificial Sequence
  Description of Artificial Sequence: Synthetic peptide
QSVSNNY

SEQ ID NO: 2001 - protein, 3 aa, Artificial Sequence
  Description of Artificial Sequence: Synthetic peptide
GAS

SEQ ID NO: 2002 - protein, 10 aa, Artificial Sequence
  Description of Artificial Sequence: Synthetic peptide
QQYGSSPPYT

SEQ ID NO: 2003 - protein, 119 aa, Artificial Sequence
  Description of Artificial Sequence: Synthetic polypeptide
EVQLVQSGAEVKKPGSSVKVSCKASGGTFSSYVISWVRQAPGQGLEWMGGILPILSTANYAQKFQGRVTITADKSTSTAYMELSSLRSEDTAVYYCARAHDYYYGMDVWGQGTTVTVSS

SEQ ID NO: 2004 - protein, 109 aa, Artificial Sequence
  Description of Artificial Sequence: Synthetic polypeptide
EIVLTQSPGTLSLSPGERATLSCRASQSVSNNYLAWYQQKPGQAPRLLIYGASSRATGIPDRFSGSGSGTDFTLTISRLEPEDFAVYYCQQYGSSPPYTFGQGTKVDIK

SEQ ID NO: 2005 - protein, 449 aa, Artificial Sequence
  Description of Artificial Sequence: Synthetic polypeptide
EVQLVQSGAEVKKPGSSVKVSCKASGGTFSSYVISWVRQAPGQGLEWMGGILPILSTANYAQKFQGRVTITADKSTSTAYMELSSLRSEDTAVYYCARAHDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2006 - protein, 216 aa, Artificial Sequence
  Description of Artificial Sequence: Synthetic polypeptide
EIVLTQSPGTLSLSPGERATLSCRASQSVSNNYLAWYQQKPGQAPRLLIYGASSRATGIPDRFSGSGSGTDFTLTISRLEPEDFAVYYCQQYGSSPPYTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2007 - protein, 5 aa, Artificial Sequence
  Description of Artificial Sequence: Synthetic peptide
GYYWN

SEQ ID NO: 2008 - protein, 16 aa, Artificial Sequence
  Description of Artificial Sequence: Synthetic peptide
RIFTTGNTNYNPSLKS

SEQ ID NO: 2009 - protein, 14 aa, Artificial Sequence
  Description of Artificial Sequence: Synthetic peptide
EKWDSSSSALYFDF

SEQ ID NO: 2010 - protein, 14 aa, Artificial Sequence
  Description of Artificial Sequence: Synthetic peptide
TGSSSNIGADYDVK

SEQ ID NO: 2011 - protein, 7 aa, Artificial Sequence
  Description of Artificial Sequence: Synthetic peptide
GNTDRPS

SEQ ID NO: 2012 - protein, 12 aa, Artificial Sequence
  Description of Artificial Sequence: Synthetic peptide
QSYDSRLTGYVV

SEQ ID NO: 2013 - protein, 7 aa, Artificial Sequence
  Description of Artificial Sequence: Synthetic peptide
GDSIRGY

SEQ ID NO: 2014 - protein, 5 aa, Artificial Sequence
  Description of Artificial Sequence: Synthetic peptide
FTTGN

SEQ ID NO: 2015 - protein, 13 aa, Artificial Sequence
  Description of Artificial Sequence: Synthetic peptide
EKWDSSSSALYFD

SEQ ID NO: 2016 - protein, 10 aa, Artificial Sequence
  Description of Artificial Sequence: Synthetic peptide
SSSNIGADYD

SEQ ID NO: 2017 - protein, 3 aa, Artificial Sequence
  Description of Artificial Sequence: Synthetic peptide
GNT

SEQ ID NO: 2018 - protein, 9 aa, Artificial Sequence
  Description of Artificial Sequence: Synthetic peptide
YDSRLTGYV

SEQ ID NO: 2019 - protein, 10 aa, Artificial Sequence
  Description of Artificial Sequence: Synthetic peptide
GDSIRGYYWN

SEQ ID NO: 2020 - protein, 9 aa, Artificial Sequence
  Description of Artificial Sequence: Synthetic peptide
RIFTTGNTN

SEQ ID NO: 2021 - protein, 14 aa, Artificial Sequence
  Description of Artificial Sequence: Synthetic peptide
EKWDSSSSALYFDF

SEQ ID NO: 2022 - protein, 14 aa, Artificial Sequence
  Description of Artificial Sequence: Synthetic peptide
TGSSSNIGADYDVK

SEQ ID NO: 2023 - protein, 7 aa, Artificial Sequence
  Description of Artificial Sequence: Synthetic peptide
GNTDRPS

SEQ ID NO: 2024 - protein, 12 aa, Artificial Sequence
  Description of Artificial Sequence: Synthetic peptide
QSYDSRLTGYVV

SEQ ID NO: 2025 - protein, 6 aa, Artificial Sequence
  Description of Artificial Sequence: Synthetic peptide
RGYYWN

SEQ ID NO: 2026 - protein, 12 aa, Artificial Sequence
  Description of Artificial Sequence: Synthetic peptide
WIGRIFTTGNTN

SEQ ID NO: 2027 - protein, 15 aa, Artificial Sequence
  Description of Artificial Sequence: Synthetic peptide
AREKWDSSSSALYFD

SEQ ID NO: 2028 - protein, 10 aa, Artificial Sequence
  Description of Artificial Sequence: Synthetic peptide
IGADYDVKWY

SEQ ID NO: 2029 - protein, 10 aa, Artificial Sequence
  Description of Artificial Sequence: Synthetic peptide
LLIYGNTDRP

SEQ ID NO: 2030 - protein, 11 aa, Artificial Sequence
  Description of Artificial Sequence: Synthetic peptide
QSYDSRLTGYV

SEQ ID NO: 2031 - protein, 8 aa, Artificial Sequence
  Description of Artificial Sequence: Synthetic peptide
GDSIRGYY

SEQ ID NO: 2032 - protein, 7 aa, Artificial Sequence
  Description of Artificial Sequence: Synthetic peptide
IFTTGNT

SEQ ID NO: 2033 - protein, 16 aa, Artificial Sequence
  Description of Artificial Sequence: Synthetic peptide
AREKWDSSSSALYFDF

SEQ ID NO: 2034 - protein, 9 aa, Artificial Sequence
  Description of Artificial Sequence: Synthetic peptide
SSNIGADYD

SEQ ID NO: 2035 - protein, 3 aa, Artificial Sequence
  Description of Artificial Sequence: Synthetic peptide
GNT

SEQ ID NO: 2036 - protein, 12 aa, Artificial Sequence
  Description of Artificial Sequence: Synthetic peptide
QSYDSRLTGYVV

SEQ ID NO: 2037 - protein, 122 aa, Artificial Sequence
  Description of Artificial Sequence: Synthetic polypeptide
EVQLVESGPGLVQPSETLSLTCTVSGDSIRGYYWNWIRQPAGKGLEWIGRIFTTGNTNYNPSLKSRLTMSLDTSKNQFSLKLNSVTAADTAVYYCAREKWDSSSSALYFDFWGQGTLVTVSS

SEQ ID NO: 2038 - protein, 112 aa, Artificial Sequence
  Description of Artificial Sequence: Synthetic polypeptide
QSVLTQAPSVSGAPGQRVTISCTGSSSNIGADYDVKWYQQLPGTAPKLLIYGNTDRPSGVPDRFSGSKSGTSASLAITGLQAEDEADYYCQSYDSRLTGYVVFGGGTKLTVL

SEQ ID NO: 2039 - protein, 452 aa, Artificial Sequence
  Description of Artificial Sequence: Synthetic polypeptide
EVQLVESGPGLVQPSETLSLTCTVSGDSIRGYYWNWIRQPAGKGLEWIGRIFTTGNTNYNPSLKSRLTMSLDTSKNQFSLKLNSVTAADTAVYYCAREKWDSSSSALYFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2040 - protein, 218 aa, Artificial Sequence
  Description of Artificial Sequence: Synthetic polypeptide
QSVLTQAPSVSGAPGQRVTISCTGSSSNIGADYDVKWYQQLPGTAPKLLIYGNTDRPSGVPDRFSGSKSGTSASLAITGLQAEDEADYYCQSYDSRLTGYVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2041 - protein, 7 aa, Artificial Sequence
  Description of Artificial Sequence: Synthetic peptide
TSGVGVG

SEQ ID NO: 2042 - protein, 16 aa, Artificial Sequence
  Description of Artificial Sequence: Synthetic peptide
LILWNDHTIYSPSLKS

SEQ ID NO: 2043 - protein, 11 aa, Artificial Sequence
  Description of Artificial Sequence: Synthetic peptide
DKWELRDAFDI

SEQ ID NO: 2044 - protein, 11 aa, Artificial Sequence
  Description of Artificial Sequence: Synthetic peptide
RASQGISRYLA

SEQ ID NO: 2045 - protein, 7 aa, Artificial Sequence
  Description of Artificial Sequence: Synthetic peptide
VASTLQS

SEQ ID NO: 2046 - protein, 9 aa, Artificial Sequence
  Description of Artificial Sequence: Synthetic peptide
QQLISYPYT

SEQ ID NO: 2047 - protein, 9 aa, Artificial Sequence
  Description of Artificial Sequence: Synthetic peptide
GFSLTTSGV

SEQ ID NO: 2048 - protein, 5 aa, Artificial Sequence
  Description of Artificial Sequence: Synthetic peptide
LWNDH

SEQ ID NO: 2049 - protein, 10 aa, Artificial Sequence
  Description of Artificial Sequence: Synthetic peptide
DKWELRDAFD

SEQ ID NO: 2050 - protein, 7 aa, Artificial Sequence
  Description of Artificial Sequence: Synthetic peptide
SQGISRY

SEQ ID NO: 2051 - protein, 3 aa, Artificial Sequence
  Description of Artificial Sequence: Synthetic peptide
VAS

SEQ ID NO: 2052 - protein, 6 aa, Artificial Sequence
  Description of Artificial Sequence: Synthetic peptide
LISYPY

SEQ ID NO: 2053 - protein, 12 aa, Artificial Sequence
  Description of Artificial Sequence: Synthetic peptide
GFSLTTSGVGVG

SEQ ID NO: 2054 - protein, 9 aa, Artificial Sequence
  Description of Artificial Sequence: Synthetic peptide
LILWNDHTI

SEQ ID NO: 2055 - protein, 11 aa, Artificial Sequence
  Description of Artificial Sequence: Synthetic peptide
DKWELRDAFDI

SEQ ID NO: 2056 - protein, 11 aa, Artificial Sequence
  Description of Artificial Sequence: Synthetic peptide
RASQGISRYLA

SEQ ID NO: 2057 - protein, 7 aa, Artificial Sequence
  Description of Artificial Sequence: Synthetic peptide
VASTLQS

SEQ ID NO: 2058 - protein, 9 aa, Artificial Sequence
  Description of Artificial Sequence: Synthetic peptide
QQLISYPYT

SEQ ID NO: 2059 - protein, 8 aa, Artificial Sequence
  Description of Artificial Sequence: Synthetic peptide
TTSGVGVG

SEQ ID NO: 2060 - protein, 12 aa, Artificial Sequence
  Description of Artificial Sequence: Synthetic peptide
WLALILWNDHTI

SEQ ID NO: 2061 - protein, 12 aa, Artificial Sequence
  Description of Artificial Sequence: Synthetic peptide
ARDKWELRDAFD

SEQ ID NO: 2062 - protein, 7 aa, Artificial Sequence
  Description of Artificial Sequence: Synthetic peptide
SRYLAWY

SEQ ID NO: 2063 - protein, 10 aa, Artificial Sequence
  Description of Artificial Sequence: Synthetic peptide
LLIYVASTLQ

SEQ ID NO: 2064 - protein, 8 aa, Artificial Sequence
  Description of Artificial Sequence: Synthetic peptide
QQLISYPY

SEQ ID NO: 2065 - protein, 10 aa, Artificial Sequence
  Description of Artificial Sequence: Synthetic peptide
GFSLTTSGVG

SEQ ID NO: 2066 - protein, 7 aa, Artificial Sequence
  Description of Artificial Sequence: Synthetic peptide
ILWNDHT

SEQ ID NO: 2067 - protein, 13 aa, Artificial Sequence
  Description of Artificial Sequence: Synthetic peptide
ARDKWELRDAFDI

SEQ ID NO: 2068 - protein, 6 aa, Artificial Sequence
  Description of Artificial Sequence: Synthetic peptide
QGISRY

SEQ ID NO: 2069 - protein, 3 aa, Artificial Sequence
  Description of Artificial Sequence: Synthetic peptide
VAS

SEQ ID NO: 2070 - protein, 9 aa, Artificial Sequence
  Description of Artificial Sequence: Synthetic peptide
QQLISYPYT

SEQ ID NO: 2071 - protein, 121 aa, Artificial Sequence
  Description of Artificial Sequence: Synthetic polypeptide
QVTLKESGPTLVKPTQTLTLTCTFSGFSLTTSGVGVGWIRQPPGKALEWLALILWNDHTIYSPSLKSRLTITKDTSKNQVVLTMTNMDPVDTAAYFCARDKWELRDAFDIWGQGTMVTVSS

SEQ ID NO: 2072 - protein, 107 aa, Artificial Sequence
  Description of Artificial Sequence: Synthetic polypeptide
EIVMTQSPSFLSASVGDRVTFTCRASQGISRYLAWYQQKPGRAPNLLIYVASTLQSGVPSRFSGSGSGTEFTLTISSLLPEDFATYYCQQLISYPYTFSQGTRLEIK

SEQ ID NO: 2073 - protein, 451 aa, Artificial Sequence
  Description of Artificial Sequence: Synthetic polypeptide
QVTLKESGPTLVKPTQTLTLTCTFSGFSLTTSGVGVGWIRQPPGKALEWLALILWNDHTIYSPSLKSRLTITKDTSKNQVVLTMTNMDPVDTAAYFCARDKWELRDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2074 - protein, 214 aa, Artificial Sequence
  Description of Artificial Sequence: Synthetic polypeptide
EIVMTQSPSFLSASVGDRVTFTCRASQGISRYLAWYQQKPGRAPNLLIYVASTLQSGVPSRFSGSGSGTEFTLTISSLLPEDFATYYCQQLISYPYTFSQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2075 - protein, 5 aa, Artificial Sequence
  Description of Artificial Sequence: Synthetic peptide
TYSVN

SEQ ID NO: 2076 - protein, 17 aa, Artificial Sequence
  Description of Artificial Sequence: Synthetic peptide
SISSDSSYIFYADSMKG

SEQ ID NO: 2077 - protein, 9 aa, Artificial Sequence
  Description of Artificial Sequence: Synthetic peptide
DSVTGPFDY

SEQ ID NO: 2078 - protein, 11 aa, Artificial Sequence
  Description of Artificial Sequence: Synthetic peptide
QASQDISHYLN

SEQ ID NO: 2079 - protein, 7 aa, Artificial Sequence
  Description of Artificial Sequence: Synthetic peptide
DSYILET

SEQ ID NO: 2080 - protein, 9 aa, Artificial Sequence
  Description of Artificial Sequence: Synthetic peptide
QQYDNLPYT

SEQ ID NO: 2081 - protein, 7 aa, Artificial Sequence
  Description of Artificial Sequence: Synthetic peptide
GFTFSTY

SEQ ID NO: 2082 - protein, 6 aa, Artificial Sequence
  Description of Artificial Sequence: Synthetic peptide
SSDSSY

SEQ ID NO: 2083 - protein, 8 aa, Artificial Sequence
  Description of Artificial Sequence: Synthetic peptide
DSVTGPFD

SEQ ID NO: 2084 - protein, 7 aa, Artificial Sequence
  Description of Artificial Sequence: Synthetic peptide
SQDISHY

SEQ ID NO: 2085 - protein, 3 aa, Artificial Sequence
  Description of Artificial Sequence: Synthetic peptide
DSY

SEQ ID NO: 2086 - protein, 6 aa, Artificial Sequence
  Description of Artificial Sequence: Synthetic peptide
YDNLPY

SEQ ID NO: 2087 - protein, 10 aa, Artificial Sequence
  Description of Artificial Sequence: Synthetic peptide
GFTFSTYSVN

SEQ ID NO: 2088 - protein, 10 aa, Artificial Sequence
  Description of Artificial Sequence: Synthetic peptide
SISSDSSYIF

SEQ ID NO: 2089 - protein, 9 aa, Artificial Sequence
  Description of Artificial Sequence: Synthetic peptide
DSVTGPFDY

SEQ ID NO: 2090 - protein, 11 aa, Artificial Sequence
  Description of Artificial Sequence: Synthetic peptide
QASQDISHYLN

SEQ ID NO: 2091 - protein, 7 aa, Artificial Sequence
  Description of Artificial Sequence: Synthetic peptide
DSYILET

SEQ ID NO: 2092 - protein, 9 aa, Artificial Sequence
  Description of Artificial Sequence: Synthetic peptide
QQYDNLPYT

SEQ ID NO: 2093 - protein, 6 aa, Artificial Sequence
  Description of Artificial Sequence: Synthetic peptide
STYSVN

SEQ ID NO: 2094 - protein, 13 aa, Artificial Sequence
  Description of Artificial Sequence: Synthetic peptide
WVSSISSDSSYIF

SEQ ID NO: 2095 - protein, 10 aa, Artificial Sequence
  Description of Artificial Sequence: Synthetic peptide
ARDSVTGPFD

SEQ ID NO: 2096 - protein, 7 aa, Artificial Sequence
  Description of Artificial Sequence: Synthetic peptide
SHYLNWY

SEQ ID NO: 2097 - protein, 10 aa, Artificial Sequence
  Description of Artificial Sequence: Synthetic peptide
LLIYDSYILE

SEQ ID NO: 2098 - protein, 8 aa, Artificial Sequence
  Description of Artificial Sequence: Synthetic peptide
QQYDNLPY

SEQ ID NO: 2099 - protein, 8 aa, Artificial Sequence
  Description of Artificial Sequence: Synthetic peptide
GFTFSTYS

SEQ ID NO: 2100 - protein, 8 aa, Artificial Sequence
  Description of Artificial Sequence: Synthetic peptide
ISSDSSYI

SEQ ID NO: 2101 - protein, 11 aa, Artificial Sequence
  Description of Artificial Sequence: Synthetic peptide
ARDSVTGPFDY

SEQ ID NO: 2102 - protein, 6 aa, Artificial Sequence
  Description of Artificial Sequence: Synthetic peptide
QDISHY

SEQ ID NO: 2103 - protein, 3 aa, Artificial Sequence
  Description of Artificial Sequence: Synthetic peptide
DSY

SEQ ID NO: 2104 - protein, 9 aa, Artificial Sequence
  Description of Artificial Sequence: Synthetic peptide
QQYDNLPYT

SEQ ID NO: 2105 - protein, 118 aa, Artificial Sequence
  Description of Artificial Sequence: Synthetic polypeptide
QVQLLESGGGLVKPGGSLRLSCAASGFTFSTYSVNWVRQAPGKGLEWVSSISSDSSYIFYADSMKGRFTISRDNAKNSLYLHMNSLRAEDTAVYYCARDSVTGPFDYWGQGTLVTVSS

SEQ ID NO: 2106 - protein, 107 aa, Artificial Sequence
  Description of Artificial Sequence: Synthetic polypeptide
DIVMTQSPSSLSASVGDRVTITCQASQDISHYLNWYQQKPGKAPKLLIYDSYILETGVTSRFSGSGSGTDFTFTINSLQPEDIAIYYCQQYDNLPYTFGQGTKVEIK

SEQ ID NO: 2107 - protein, 448 aa, Artificial Sequence
  Description of Artificial Sequence: Synthetic polypeptide
QVQLLESGGGLVKPGGSLRLSCAASGFTFSTYSVNWVRQAPGKGLEWVSSISSDSSYIFYADSMKGRFTISRDNAKNSLYLHMNSLRAEDTAVYYCARDSVTGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2108 - protein, 214 aa, Artificial Sequence
  Description of Artificial Sequence: Synthetic polypeptide
DIVMTQSPSSLSASVGDRVTITCQASQDISHYLNWYQQKPGKAPKLLIYDSYILETGVTSRFSGSGSGTDFTFTINSLQPEDIAIYYCQQYDNLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2109 - protein, 5 aa, Artificial Sequence
  Description of Artificial Sequence: Synthetic peptide
NYFWN

SEQ ID NO: 2110 - protein, 16 aa, Artificial Sequence
  Description of Artificial Sequence: Synthetic peptide
YIFYSGSTSYNPSLKS

SEQ ID NO: 2111 - protein, 12 aa, Artificial Sequence
  Description of Artificial Sequence: Synthetic peptide
VGRWELRTAFDI

SEQ ID NO: 2112 - protein, 13 aa, Artificial Sequence
  Description of Artificial Sequence: Synthetic peptide
SGSSSNIGSNTVN

SEQ ID NO: 2113 - protein, 7 aa, Artificial Sequence
  Description of Artificial Sequence: Synthetic peptide
SNNQRPS

SEQ ID NO: 2114 - protein, 12 aa, Artificial Sequence
  Description of Artificial Sequence: Synthetic peptide
AAWDDSLNGPGV

SEQ ID NO: 2115 - protein, 7 aa, Artificial Sequence
  Description of Artificial Sequence: Synthetic peptide
GGSITNY

SEQ ID NO: 2116 - protein, 5 aa, Artificial Sequence
  Description of Artificial Sequence: Synthetic peptide
FYSGS

SEQ ID NO: 2117 - protein, 11 aa, Artificial Sequence
  Description of Artificial Sequence: Synthetic peptide
VGRWELRTAFD

SEQ ID NO: 2118 - protein, 9 aa, Artificial Sequence
  Description of Artificial Sequence: Synthetic peptide
SSSNIGSNT

SEQ ID NO: 2119 - protein, 3 aa, Artificial Sequence
  Description of Artificial Sequence: Synthetic peptide
SNN

SEQ ID NO: 2120 - protein, 9 aa, Artificial Sequence
  Description of Artificial Sequence: Synthetic peptide
WDDSLNGPG

SEQ ID NO: 2121 - protein, 10 aa, Artificial Sequence
  Description of Artificial Sequence: Synthetic peptide
GGSITNYFWN

SEQ ID NO: 2122 - protein, 9 aa, Artificial Sequence
  Description of Artificial Sequence: Synthetic peptide
YIFYSGSTS

SEQ ID NO: 2123 - protein, 12 aa, Artificial Sequence
  Description of Artificial Sequence: Synthetic peptide
VGRWELRTAFDI

SEQ ID NO: 2124 - protein, 13 aa, Artificial Sequence
  Description of Artificial Sequence: Synthetic peptide
SGSSSNIGSNTVN

SEQ ID NO: 2125 - protein, 7 aa, Artificial Sequence
  Description of Artificial Sequence: Synthetic peptide
SNNQRPS

SEQ ID NO: 2126 - protein, 12 aa, Artificial Sequence
  Description of Artificial Sequence: Synthetic peptide
AAWDDSLNGPGV

SEQ ID NO: 2127 - protein, 6 aa, Artificial Sequence
  Description of Artificial Sequence: Synthetic peptide
TNYFWN

SEQ ID NO: 2128 - protein, 12 aa, Artificial Sequence
  Description of Artificial Sequence: Synthetic peptide
WIGYIFYSGSTS

SEQ ID NO: 2129 - protein, 13 aa, Artificial Sequence
  Description of Artificial Sequence: Synthetic peptide
ARVGRWELRTAFD

SEQ ID NO: 2130 - protein, 9 aa, Artificial Sequence
  Description of Artificial Sequence: Synthetic peptide
IGSNTVNWY

SEQ ID NO: 2131 - protein, 10 aa, Artificial Sequence
  Description of Artificial Sequence: Synthetic peptide
LLIYSNNQRP

SEQ ID NO: 2132 - protein, 11 aa, Artificial Sequence
  Description of Artificial Sequence: Synthetic peptide
AAWDDSLNGPG

SEQ ID NO: 2133 - protein, 8 aa, Artificial Sequence
  Description of Artificial Sequence: Synthetic peptide
GGSITNYF

SEQ ID NO: 2134 - protein, 7 aa, Artificial Sequence
  Description of Artificial Sequence: Synthetic peptide
IFYSGST

SEQ ID NO: 2135 - protein, 14 aa, Artificial Sequence
  Description of Artificial Sequence: Synthetic peptide
ARVGRWELRTAFDI

SEQ ID NO: 2136 - protein, 8 aa, Artificial Sequence
  Description of Artificial Sequence: Synthetic peptide
SSNIGSNT

SEQ ID NO: 2137 - protein, 3 aa, Artificial Sequence
  Description of Artificial Sequence: Synthetic peptide
SNN

SEQ ID NO: 2138 - protein, 12 aa, Artificial Sequence
  Description of Artificial Sequence: Synthetic peptide
AAWDDSLNGPGV

SEQ ID NO: 2139 - protein, 120 aa, Artificial Sequence
  Description of Artificial Sequence: Synthetic polypeptide
EVQLLESGPGLVKPSETLSLTCSVSGGSITNYFWNWIRQPPGKGLEWIGYIFYSGSTSYNPSLKSRVTISVDTSKNRFSLKLISVTAADTAVYYCARVGRWELRTAFDIWGQGTMVTVSS

SEQ ID NO: 2140 - protein, 111 aa, Artificial Sequence
  Description of Artificial Sequence: Synthetic polypeptide
QSALTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPGVFGGGTKLTVL

SEQ ID NO: 2141 - protein, 450 aa, Artificial Sequence
  Description of Artificial Sequence: Synthetic polypeptide
EVQLLESGPGLVKPSETLSLTCSVSGGSITNYFWNWIRQPPGKGLEWIGYIFYSGSTSYNPSLKSRVTISVDTSKNRFSLKLISVTAADTAVYYCARVGRWELRTAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2142 - protein, 217 aa, Artificial Sequence
  Description of Artificial Sequence: Synthetic polypeptide
QSALTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2143 - protein, 5 aa, Artificial Sequence
  Description of Artificial Sequence: Synthetic peptide
TYRMN

SEQ ID NO: 2144 - protein, 17 aa, Artificial Sequence
  Description of Artificial Sequence: Synthetic peptide
SISSSSIYIHSADSVKG

SEQ ID NO: 2145 - protein, 10 aa, Artificial Sequence
  Description of Artificial Sequence: Synthetic peptide
ERVYTVSFDY

SEQ ID NO: 2146 - protein, 11 aa, Artificial Sequence
  Description of Artificial Sequence: Synthetic peptide
QASQDISHYLN

SEQ ID NO: 2147 - protein, 7 aa, Artificial Sequence
  Description of Artificial Sequence: Synthetic peptide
DSYILET

SEQ ID NO: 2148 - protein, 9 aa, Artificial Sequence
  Description of Artificial Sequence: Synthetic peptide
QQYDNLPYT

SEQ ID NO: 2149 - protein, 7 aa, Artificial Sequence
  Description of Artificial Sequence: Synthetic peptide
GFTFTTY

SEQ ID NO: 2150 - protein, 6 aa, Artificial Sequence
  Description of Artificial Sequence: Synthetic peptide
SSSSIY

SEQ ID NO: 2151 - protein, 9 aa, Artificial Sequence
  Description of Artificial Sequence: Synthetic peptide
ERVYTVSFD

SEQ ID NO: 2152 - protein, 7 aa, Artificial Sequence
  Description of Artificial Sequence: Synthetic peptide
SQDISHY

SEQ ID NO: 2153 - protein, 3 aa, Artificial Sequence
  Description of Artificial Sequence: Synthetic peptide
DSY

SEQ ID NO: 2154 - protein, 6 aa, Artificial Sequence
  Description of Artificial Sequence: Synthetic peptide
YDNLPY

SEQ ID NO: 2155 - protein, 10 aa, Artificial Sequence
  Description of Artificial Sequence: Synthetic peptide
GFTFTTYRMN

SEQ ID NO: 2156 - protein, 10 aa, Artificial Sequence
  Description of Artificial Sequence: Synthetic peptide
SISSSSIYIH

SEQ ID NO: 2157 - protein, 10 aa, Artificial Sequence
  Description of Artificial Sequence: Synthetic peptide
ERVYTVSFDY

SEQ ID NO: 2158 - protein, 11 aa, Artificial Sequence
  Description of Artificial Sequence: Synthetic peptide
QASQDISHYLN

SEQ ID NO: 2159 - protein, 7 aa, Artificial Sequence
  Description of Artificial Sequence: Synthetic peptide
DSYILET

SEQ ID NO: 2160 - protein, 9 aa, Artificial Sequence
  Description of Artificial Sequence: Synthetic peptide
QQYDNLPYT

SEQ ID NO: 2161 - protein, 6 aa, Artificial Sequence
  Description of Artificial Sequence: Synthetic peptide
TTYRMN

SEQ ID NO: 2162 - protein, 13 aa, Artificial Sequence
  Description of Artificial Sequence: Synthetic peptide
WVSSISSSSIYIH

SEQ ID NO: 2163 - protein, 11 aa, Artificial Sequence
  Description of Artificial Sequence: Synthetic peptide
ARERVYTVSFD

SEQ ID NO: 2164 - protein, 7 aa, Artificial Sequence
  Description of Artificial Sequence: Synthetic peptide
SHYLNWY

SEQ ID NO: 2165 - protein, 10 aa, Artificial Sequence
  Description of Artificial Sequence: Synthetic peptide
LLIYDSYILE

SEQ ID NO: 2166 - protein, 8 aa, Artificial Sequence
  Description of Artificial Sequence: Synthetic peptide
QQYDNLPY

SEQ ID NO: 2167 - protein, 8 aa, Artificial Sequence
  Description of Artificial Sequence: Synthetic peptide
GFTFTTYR

SEQ ID NO: 2168 - protein, 8 aa, Artificial Sequence
  Description of Artificial Sequence: Synthetic peptide
ISSSSIYI

SEQ ID NO: 2169 - protein, 12 aa, Artificial Sequence
  Description of Artificial Sequence: Synthetic peptide
ARERVYTVSFDY

SEQ ID NO: 2170 - protein, 6 aa, Artificial Sequence
  Description of Artificial Sequence: Synthetic peptide
QDISHY

SEQ ID NO: 2171 - protein, 3 aa, Artificial Sequence
  Description of Artificial Sequence: Synthetic peptide
DSY

SEQ ID NO: 2172 - protein, 9 aa, Artificial Sequence
  Description of Artificial Sequence: Synthetic peptide
QQYDNLPYT

SEQ ID NO: 2173 - protein, 119 aa, Artificial Sequence
  Description of Artificial Sequence: Synthetic polypeptide
QVQLVQSGGGLVKPGGSLRLSCAASGFTFTTYRMNWVRQAPGKGLEWVSSISSSSIYIHSADSVKGRFTISRDNAKNSLYLQMNSLRAEDSAIYYCARERVYTVSFDYWGQGTLVTVSS

SEQ ID NO: 2174 - protein, 107 aa, Artificial Sequence
  Description of Artificial Sequence: Synthetic polypeptide
DIQMTQSPSSLSASVGDRVTITCQASQDISHYLNWYQQKPGKAPKLLIYDSYILETGVTSRFSGSGSGTDFTFTINSLQPEDIAIYYCQQYDNLPYTFGQGTKVEIK

SEQ ID NO: 2175 - protein, 449 aa, Artificial Sequence
  Description of Artificial Sequence: Synthetic polypeptide
QVQLVQSGGGLVKPGGSLRLSCAASGFTFTTYRMNWVRQAPGKGLEWVSSISSSSIYIHSADSVKGRFTISRDNAKNSLYLQMNSLRAEDSAIYYCARERVYTVSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2176 - protein, 214 aa, Artificial Sequence
  Description of Artificial Sequence: Synthetic polypeptide
DIQMTQSPSSLSASVGDRVTITCQASQDISHYLNWYQQKPGKAPKLLIYDSYILETGVTSRFSGSGSGTDFTFTINSLQPEDIAIYYCQQYDNLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2177 - protein, 7 aa, Artificial Sequence
  Description of Artificial Sequence: Synthetic peptide
THGVGVG

SEQ ID NO: 2178 - protein, 16 aa, Artificial Sequence
  Description of Artificial Sequence: Synthetic peptide
LIYWNADKHYSPSLKS

SEQ ID NO: 2179 - protein, 10 aa, Artificial Sequence
  Description of Artificial Sequence: Synthetic peptide
EGDWGHYFDF

SEQ ID NO: 2180 - protein, 13 aa, Artificial Sequence
  Description of Artificial Sequence: Synthetic peptide
SGSSSNIGNNDVS

SEQ ID NO: 2181 - protein, 7 aa, Artificial Sequence
  Description of Artificial Sequence: Synthetic peptide
DNNRRPS

SEQ ID NO: 2182 - protein, 12 aa, Artificial Sequence
  Description of Artificial Sequence: Synthetic peptide
ETWDSSLSAIWV

SEQ ID NO: 2183 - protein, 9 aa, Artificial Sequence
  Description of Artificial Sequence: Synthetic peptide
GFSLTTHGV

SEQ ID NO: 2184 - protein, 5 aa, Artificial Sequence
  Description of Artificial Sequence: Synthetic peptide
YWNAD

SEQ ID NO: 2185 - protein, 9 aa, Artificial Sequence
  Description of Artificial Sequence: Synthetic peptide
EGDWGHYFD

SEQ ID NO: 2186 - protein, 9 aa, Artificial Sequence
  Description of Artificial Sequence: Synthetic peptide
SSSNIGNND

SEQ ID NO: 2187 - protein, 3 aa, Artificial Sequence
  Description of Artificial Sequence: Synthetic peptide
DNN

SEQ ID NO: 2188 - protein, 9 aa, Artificial Sequence
  Description of Artificial Sequence: Synthetic peptide
WDSSLSAIW

SEQ ID NO: 2189 - protein, 12 aa, Artificial Sequence
  Description of Artificial Sequence: Synthetic peptide
GFSLTTHGVGVG

SEQ ID NO: 2190 - protein, 9 aa, Artificial Sequence
  Description of Artificial Sequence: Synthetic peptide
LIYWNADKH

SEQ ID NO: 2191 - protein, 10 aa, Artificial Sequence
  Description of Artificial Sequence: Synthetic peptide
EGDWGHYFDF

SEQ ID NO: 2192 - protein, 13 aa, Artificial Sequence
  Description of Artificial Sequence: Synthetic peptide
SGSSSNIGNNDVS

SEQ ID NO: 2193 - protein, 7 aa, Artificial Sequence
  Description of Artificial Sequence: Synthetic peptide
DNNRRPS

SEQ ID NO: 2194 - protein, 12 aa, Artificial Sequence
  Description of Artificial Sequence: Synthetic peptide
ETWDSSLSAIWV

SEQ ID NO: 2195 - protein, 8 aa, Artificial Sequence
  Description of Artificial Sequence: Synthetic peptide
TTHGVGVG

SEQ ID NO: 2196 - protein, 12 aa, Artificial Sequence
  Description of Artificial Sequence: Synthetic peptide
WLALIYWNADKH

SEQ ID NO: 2197 - protein, 11 aa, Artificial Sequence
  Description of Artificial Sequence: Synthetic peptide
AHEGDWGHYFD

SEQ ID NO: 2198 - protein, 9 aa, Artificial Sequence
  Description of Artificial Sequence: Synthetic peptide
IGNNDVSWY

SEQ ID NO: 2199 - protein, 10 aa, Artificial Sequence
  Description of Artificial Sequence: Synthetic peptide
LLIYDNNRRP

SEQ ID NO: 2200 - protein, 11 aa, Artificial Sequence
  Description of Artificial Sequence: Synthetic peptide
ETWDSSLSAIW

SEQ ID NO: 2201 - protein, 10 aa, Artificial Sequence
  Description of Artificial Sequence: Synthetic peptide
GFSLTTHGVG

SEQ ID NO: 2202 - protein, 7 aa, Artificial Sequence
  Description of Artificial Sequence: Synthetic peptide
IYWNADK

SEQ ID NO: 2203 - protein, 12 aa, Artificial Sequence
  Description of Artificial Sequence: Synthetic peptide
AHEGDWGHYFDF

SEQ ID NO: 2204 - protein, 8 aa, Artificial Sequence
  Description of Artificial Sequence: Synthetic peptide
SSNIGNND

SEQ ID NO: 2205 - protein, 3 aa, Artificial Sequence
  Description of Artificial Sequence: Synthetic peptide
DNN

SEQ ID NO: 2206 - protein, 12 aa, Artificial Sequence
  Description of Artificial Sequence: Synthetic peptide
ETWDSSLSAIWV

SEQ ID NO: 2207 - protein, 120 aa, Artificial Sequence
  Description of Artificial Sequence: Synthetic polypeptide
QVTLKESGPTLVKPTQTLTLTCTFSGFSLTTHGVGVGWIRQPPRKALEWLALIYWNADKHYSPSLKSRLTITKDTSKNQVVLTMTHMDPVDTATYYCAHEGDWGHYFDFWGQGTLVTVSS

SEQ ID NO: 2208 - protein, 111 aa, Artificial Sequence
  Description of Artificial Sequence: Synthetic polypeptide
QLVLTQPPSVSAAPGQKVTISCSGSSSNIGNNDVSWYQQLPGTAPKLLIYDNNRRPSGIPDRFSGSKSGTSATLGITGLQTGDEADYYCETWDSSLSAIWVFGGGTKVTVL

SEQ ID NO: 2209 - protein, 450 aa, Artificial Sequence
  Description of Artificial Sequence: Synthetic polypeptide
QVTLKESGPTLVKPTQTLTLTCTFSGFSLTTHGVGVGWIRQPPRKALEWLALIYWNADKHYSPSLKSRLTITKDTSKNQVVLTMTHMDPVDTATYYCAHEGDWGHYFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2210 - protein, 217 aa, Artificial Sequence
  Description of Artificial Sequence: Synthetic polypeptide
QLVLTQPPSVSAAPGQKVTISCSGSSSNIGNNDVSWYQQLPGTAPKLLIYDNNRRPSGIPDRFSGSKSGTSATLGITGLQTGDEADYYCETWDSSLSAIWVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2211 - protein, 5 aa, Artificial Sequence
  Description of Artificial Sequence: Synthetic peptide
SYFWS

SEQ ID NO: 2212 - protein, 16 aa, Artificial Sequence
  Description of Artificial Sequence: Synthetic peptide
YIFYSGSTNYNPSLKS

SEQ ID NO: 2213 - protein, 12 aa, Artificial Sequence
  Description of Artificial Sequence: Synthetic peptide
VGRWELRGAFDI

SEQ ID NO: 2214 - protein, 13 aa, Artificial Sequence
  Description of Artificial Sequence: Synthetic peptide
SGSSSNIGSNTVN

SEQ ID NO: 2215 - protein, 7 aa, Artificial Sequence
  Description of Artificial Sequence: Synthetic peptide
SNNQRPS

SEQ ID NO: 2216 - protein, 12 aa, Artificial Sequence
  Description of Artificial Sequence: Synthetic peptide
AAWDDSLNSPGV

SEQ ID NO: 2217 - protein, 7 aa, Artificial Sequence
  Description of Artificial Sequence: Synthetic peptide
GGSISSY

SEQ ID NO: 2218 - protein, 5 aa, Artificial Sequence
  Description of Artificial Sequence: Synthetic peptide
FYSGS

SEQ ID NO: 2219 - protein, 11 aa, Artificial Sequence
  Description of Artificial Sequence: Synthetic peptide
VGRWELRGAFD

SEQ ID NO: 2220 - protein, 9 aa, Artificial Sequence
  Description of Artificial Sequence: Synthetic peptide
SSSNIGSNT

SEQ ID NO: 2221 - protein, 3 aa, Artificial Sequence
  Description of Artificial Sequence: Synthetic peptide
SNN

SEQ ID NO: 2222 - protein, 9 aa, Artificial Sequence
  Description of Artificial Sequence: Synthetic peptide
WDDSLNSPG

SEQ ID NO: 2223 - protein, 10 aa, Artificial Sequence
  Description of Artificial Sequence: Synthetic peptide
GGSISSYFWS

SEQ ID NO: 2224 - protein, 9 aa, Artificial Sequence
  Description of Artificial Sequence: Synthetic peptide
YIFYSGSTN

SEQ ID NO: 2225 - protein, 12 aa, Artificial Sequence
  Description of Artificial Sequence: Synthetic peptide
VGRWELRGAFDI

SEQ ID NO: 2226 - protein, 13 aa, Artificial Sequence
  Description of Artificial Sequence: Synthetic peptide
SGSSSNIGSNTVN

SEQ ID NO: 2227 - protein, 7 aa, Artificial Sequence
  Description of Artificial Sequence: Synthetic peptide
SNNQRPS

SEQ ID NO: 2228 - protein, 12 aa, Artificial Sequence
  Description of Artificial Sequence: Synthetic peptide
AAWDDSLNSPGV

SEQ ID NO: 2229 - protein, 6 aa, Artificial Sequence
  Description of Artificial Sequence: Synthetic peptide
SSYFWS

SEQ ID NO: 2230 - protein, 12 aa, Artificial Sequence
  Description of Artificial Sequence: Synthetic peptide
WIGYIFYSGSTN

SEQ ID NO: 2231 - protein, 13 aa, Artificial Sequence
  Description of Artificial Sequence: Synthetic peptide
ARVGRWELRGAFD

SEQ ID NO: 2232 - protein, 9 aa, Artificial Sequence
  Description of Artificial Sequence: Synthetic peptide
IGSNTVNWY

SEQ ID NO: 2233 - protein, 10 aa, Artificial Sequence
  Description of Artificial Sequence: Synthetic peptide
LLIYSNNQRP

SEQ ID NO: 2234 - protein, 11 aa, Artificial Sequence
  Description of Artificial Sequence: Synthetic peptide
AAWDDSLNSPG

SEQ ID NO: 2235 - protein, 8 aa, Artificial Sequence
  Description of Artificial Sequence: Synthetic peptide
GGSISSYF

SEQ ID NO: 2236 - protein, 7 aa, Artificial Sequence
  Description of Artificial Sequence: Synthetic peptide
IFYSGST

SEQ ID NO: 2237 - protein, 14 aa, Artificial Sequence
  Description of Artificial Sequence: Synthetic peptide
ARVGRWELRGAFDI

SEQ ID NO: 2238 - protein, 8 aa, Artificial Sequence
  Description of Artificial Sequence: Synthetic peptide
SSNIGSNT

SEQ ID NO: 2239 - protein, 3 aa, Artificial Sequence
  Description of Artificial Sequence: Synthetic peptide
SNN

SEQ ID NO: 2240 - protein, 12 aa, Artificial Sequence
  Description of Artificial Sequence: Synthetic peptide
AAWDDSLNSPGV

SEQ ID NO: 2241 - protein, 120 aa, Artificial Sequence
  Description of Artificial Sequence: Synthetic polypeptide
QVQLQESGPGLVKPSETLSLTCTVSGGSISSYFWSWIRQPPGKGLEWIGYIFYSGSTNYNPSLKSRVTILVDTSKNHFSLKLSSVTAADTAVYYCARVGRWELRGAFDIWGQGTMVTVSS

SEQ ID NO: 2242 - protein, 111 aa, Artificial Sequence
  Description of Artificial Sequence: Synthetic polypeptide
QPVLTQSSSASGTPGQRVTISCSGSSSNIGSNTVNWYQQFPGTAPKLLIYSNNQRPSGVPDRFSGSKSGTSASLAISGLQSEDEAEYYCAAWDDSLNSPGVFGGGTKLTVL

SEQ ID NO: 2243 - protein, 450 aa, Artificial Sequence
  Description of Artificial Sequence: Synthetic polypeptide
QVQLQESGPGLVKPSETLSLTCTVSGGSISSYFWSWIRQPPGKGLEWIGYIFYSGSTNYNPSLKSRVTILVDTSKNHFSLKLSSVTAADTAVYYCARVGRWELRGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2244 - protein, 217 aa, Artificial Sequence
  Description of Artificial Sequence: Synthetic polypeptide
QPVLTQSSSASGTPGQRVTISCSGSSSNIGSNTVNWYQQFPGTAPKLLIYSNNQRPSGVPDRFSGSKSGTSASLAISGLQSEDEAEYYCAAWDDSLNSPGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2245 - protein, 5 aa, Artificial Sequence
  Description of Artificial Sequence: Synthetic peptide
SYYWN

SEQ ID NO: 2246 - protein, 16 aa, Artificial Sequence
  Description of Artificial Sequence: Synthetic peptide
RIYTIGNTNYNPSLKS

SEQ ID NO: 2247 - protein, 17 aa, Artificial Sequence
  Description of Artificial Sequence: Synthetic peptide
EGYYDSSGSFFPGAFGI

SEQ ID NO: 2248 - protein, 14 aa, Artificial Sequence
  Description of Artificial Sequence: Synthetic peptide
TGTSNDVGSYNLVS

SEQ ID NO: 2249 - protein, 7 aa, Artificial Sequence
  Description of Artificial Sequence: Synthetic peptide
AGSKRPS

SEQ ID NO: 2250 - protein, 10 aa, Artificial Sequence
  Description of Artificial Sequence: Synthetic peptide
CSFAGATNVV

SEQ ID NO: 2251 - protein, 7 aa, Artificial Sequence
  Description of Artificial Sequence: Synthetic peptide
SGSISSY

SEQ ID NO: 2252 - protein, 5 aa, Artificial Sequence
  Description of Artificial Sequence: Synthetic peptide
YTIGN

SEQ ID NO: 2253 - protein, 16 aa, Artificial Sequence
  Description of Artificial Sequence: Synthetic peptide
EGYYDSSGSFFPGAFG

SEQ ID NO: 2254 - protein, 10 aa, Artificial Sequence
  Description of Artificial Sequence: Synthetic peptide
TSNDVGSYNL

SEQ ID NO: 2255 - protein, 3 aa, Artificial Sequence
  Description of Artificial Sequence: Synthetic peptide
AGS

SEQ ID NO: 2256 - protein, 7 aa, Artificial Sequence
  Description of Artificial Sequence: Synthetic peptide
FAGATNV

SEQ ID NO: 2257 - protein, 10 aa, Artificial Sequence
  Description of Artificial Sequence: Synthetic peptide
SGSISSYYWN

SEQ ID NO: 2258 - protein, 9 aa, Artificial Sequence
  Description of Artificial Sequence: Synthetic peptide
RIYTIGNTN

SEQ ID NO: 2259 - protein, 17 aa, Artificial Sequence
  Description of Artificial Sequence: Synthetic peptide
EGYYDSSGSFFPGAFGI

SEQ ID NO: 2260 - protein, 14 aa, Artificial Sequence
  Description of Artificial Sequence: Synthetic peptide
TGTSNDVGSYNLVS

SEQ ID NO: 2261 - protein, 7 aa, Artificial Sequence
  Description of Artificial Sequence: Synthetic peptide
AGSKRPS

SEQ ID NO: 2262 - protein, 10 aa, Artificial Sequence
  Description of Artificial Sequence: Synthetic peptide
CSFAGATNVV

SEQ ID NO: 2263 - protein, 6 aa, Artificial Sequence
  Description of Artificial Sequence: Synthetic peptide
SSYYWN

SEQ ID NO: 2264 - protein, 12 aa, Artificial Sequence
  Description of Artificial Sequence: Synthetic peptide
WVGRIYTIGNTN

SEQ ID NO: 2265 - protein, 18 aa, Artificial Sequence
  Description of Artificial Sequence: Synthetic peptide
AREGYYDSSGSFFPGAFG

SEQ ID NO: 2266 - protein, 10 aa, Artificial Sequence
  Description of Artificial Sequence: Synthetic peptide
VGSYNLVSWY

SEQ ID NO: 2267 - protein, 10 aa, Artificial Sequence
  Description of Artificial Sequence: Synthetic peptide
LMIYAGSKRP

SEQ ID NO: 2268 - protein, 9 aa, Artificial Sequence
  Description of Artificial Sequence: Synthetic peptide
CSFAGATNV

SEQ ID NO: 2269 - protein, 8 aa, Artificial Sequence
  Description of Artificial Sequence: Synthetic peptide
SGSISSYY

SEQ ID NO: 2270 - protein, 7 aa, Artificial Sequence
  Description of Artificial Sequence: Synthetic peptide
IYTIGNT

SEQ ID NO: 2271 - protein, 19 aa, Artificial Sequence
  Description of Artificial Sequence: Synthetic peptide
AREGYYDSSGSFFPGAFGI

SEQ ID NO: 2272 - protein, 9 aa, Artificial Sequence
  Description of Artificial Sequence: Synthetic peptide
SNDVGSYNL

SEQ ID NO: 2273 - protein, 3 aa, Artificial Sequence
  Description of Artificial Sequence: Synthetic peptide
AGS

SEQ ID NO: 2274 - protein, 10 aa, Artificial Sequence
  Description of Artificial Sequence: Synthetic peptide
CSFAGATNVV

SEQ ID NO: 2275 - protein, 125 aa, Artificial Sequence
  Description of Artificial Sequence: Synthetic polypeptide
QVQLQESGPGLVKPSETLSLTCTVSSGSISSYYWNWIRQPAGKGLEWVGRIYTIGNTNYNPSLKSRVTMSIDTSKNQFSLNLSSVTAADTAVYFCAREGYYDSSGSFFPGAFGIWGQGTMVTVSS

SEQ ID NO: 2276 - protein, 110 aa, Artificial Sequence
  Description of Artificial Sequence: Synthetic polypeptide
SSELTQPASVSGSPGQSITISCTGTSNDVGSYNLVSWYQQHPGKAPKLMIYAGSKRPSGISNRFSGSKSGNTASLTISGLQAEDEADYYCCSFAGATNVVFGGGTKLTVL

SEQ ID NO: 2277 - protein, 455 aa, Artificial Sequence
  Description of Artificial Sequence: Synthetic polypeptide
QVQLQESGPGLVKPSETLSLTCTVSSGSISSYYWNWIRQPAGKGLEWVGRIYTIGNTNYNPSLKSRVTMSIDTSKNQFSLNLSSVTAADTAVYFCAREGYYDSSGSFFPGAFGIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2278 - protein, 216 aa, Artificial Sequence
  Description of Artificial Sequence: Synthetic polypeptide
SSELTQPASVSGSPGQSITISCTGTSNDVGSYNLVSWYQQHPGKAPKLMIYAGSKRPSGISNRFSGSKSGNTASLTISGLQAEDEADYYCCSFAGATNVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2279 - protein, 5 aa, Artificial Sequence
  Description of Artificial Sequence: Synthetic peptide
GYYWN

SEQ ID NO: 2280 - protein, 16 aa, Artificial Sequence
  Description of Artificial Sequence: Synthetic peptide
RIFTTGNTNYNPSLKS

SEQ ID NO: 2281 - protein, 14 aa, Artificial Sequence
  Description of Artificial Sequence: Synthetic peptide
ERWDSSSSALYFDY

SEQ ID NO: 2282 - protein, 14 aa, Artificial Sequence
  Description of Artificial Sequence: Synthetic peptide
TGSSSNIGADYDIK

SEQ ID NO: 2283 - protein, 7 aa, Artificial Sequence
  Description of Artificial Sequence: Synthetic peptide
GNSNRPS

SEQ ID NO: 2284 - protein, 12 aa, Artificial Sequence
  Description of Artificial Sequence: Synthetic peptide
QSYDSSMSGYVV

SEQ ID NO: 2285 - protein, 7 aa, Artificial Sequence
  Description of Artificial Sequence: Synthetic peptide
GDSISGY

SEQ ID NO: 2286 - protein, 5 aa, Artificial Sequence
  Description of Artificial Sequence: Synthetic peptide
FTTGN

SEQ ID NO: 2287 - protein, 13 aa, Artificial Sequence
  Description of Artificial Sequence: Synthetic peptide
ERWDSSSSALYFD

SEQ ID NO: 2288 - protein, 10 aa, Artificial Sequence
  Description of Artificial Sequence: Synthetic peptide
SSSNIGADYD

SEQ ID NO: 2289 - protein, 3 aa, Artificial Sequence
  Description of Artificial Sequence: Synthetic peptide
GNS

SEQ ID NO: 2290 - protein, 9 aa, Artificial Sequence
  Description of Artificial Sequence: Synthetic peptide
YDSSMSGYV

SEQ ID NO: 2291 - protein, 10 aa, Artificial Sequence
  Description of Artificial Sequence: Synthetic peptide
GDSISGYYWN

SEQ ID NO: 2292 - protein, 9 aa, Artificial Sequence
  Description of Artificial Sequence: Synthetic peptide
RIFTTGNTN

SEQ ID NO: 2293 - protein, 14 aa, Artificial Sequence
  Description of Artificial Sequence: Synthetic peptide
ERWDSSSSALYFDY

SEQ ID NO: 2294 - protein, 14 aa, Artificial Sequence
  Description of Artificial Sequence: Synthetic peptide
TGSSSNIGADYDIK

SEQ ID NO: 2295 - protein, 7 aa, Artificial Sequence
  Description of Artificial Sequence: Synthetic peptide
GNSNRPS

SEQ ID NO: 2296 - protein, 12 aa, Artificial Sequence
  Description of Artificial Sequence: Synthetic peptide
QSYDSSMSGYVV

SEQ ID NO: 2297 - protein, 6 aa, Artificial Sequence
  Description of Artificial Sequence: Synthetic peptide
SGYYWN

SEQ ID NO: 2298 - protein, 12 aa, Artificial Sequence
  Description of Artificial Sequence: Synthetic peptide
WIGRIFTTGNTN

SEQ ID NO: 2299 - protein, 15 aa, Artificial Sequence
  Description of Artificial Sequence: Synthetic peptide
ARERWDSSSSALYFD

SEQ ID NO: 2300 - protein, 10 aa, Artificial Sequence
  Description of Artificial Sequence: Synthetic peptide
IGADYDIKWY

SEQ ID NO: 2301 - protein, 10 aa, Artificial Sequence
  Description of Artificial Sequence: Synthetic peptide
LLIYGNSNRP

SEQ ID NO: 2302 - protein, 11 aa, Artificial Sequence
  Description of Artificial Sequence: Synthetic peptide
QSYDSSMSGYV

SEQ ID NO: 2303 - protein, 8 aa, Artificial Sequence
  Description of Artificial Sequence: Synthetic peptide
GDSISGYY

SEQ ID NO: 2304 - protein, 7 aa, Artificial Sequence
  Description of Artificial Sequence: Synthetic peptide
IFTTGNT

SEQ ID NO: 2305 - protein, 16 aa, Artificial Sequence
  Description of Artificial Sequence: Synthetic peptide
ARERWDSSSSALYFDY

SEQ ID NO: 2306 - protein, 9 aa, Artificial Sequence
  Description of Artificial Sequence: Synthetic peptide
SSNIGADYD

SEQ ID NO: 2307 - protein, 3 aa, Artificial Sequence
  Description of Artificial Sequence: Synthetic peptide
GNS

SEQ ID NO: 2308 - protein, 12 aa, Artificial Sequence
  Description of Artificial Sequence: Synthetic peptide
QSYDSSMSGYVV

SEQ ID NO: 2309 - protein, 122 aa, Artificial Sequence
  Description of Artificial Sequence: Synthetic polypeptide
QVQLQESGPGLVKPSETLSLTCTVSGDSISGYYWNYIRQPAGKGLDWIGRIFTTGNTNYNPSLKSRVTMSVDTSKNQFSLKLTSVTAADTAVYYCARERWDSSSSALYFDYWGQGTLVTVSS

SEQ ID NO: 2310 - protein, 112 aa, Artificial Sequence
  Description of Artificial Sequence: Synthetic polypeptide
QSVLTQPPSVSGAPGQRVTISCTGSSSNIGADYDIKWYQQLPGTAPKLLIYGNSNRPSGVPDRFSGSKSGTSVSLAITGLQAEDEADYYCQSYDSSMSGYVVFGGGTKLTVL

SEQ ID NO: 2311 - protein, 452 aa, Artificial Sequence
  Description of Artificial Sequence: Synthetic polypeptide
QVQLQESGPGLVKPSETLSLTCTVSGDSISGYYWNYIRQPAGKGLDWIGRIFTTGNTNYNPSLKSRVTMSVDTSKNQFSLKLTSVTAADTAVYYCARERWDSSSSALYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2312 - protein, 218 aa, Artificial Sequence
  Description of Artificial Sequence: Synthetic polypeptide
QSVLTQPPSVSGAPGQRVTISCTGSSSNIGADYDIKWYQQLPGTAPKLLIYGNSNRPSGVPDRFSGSKSGTSVSLAITGLQAEDEADYYCQSYDSSMSGYVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2313 - protein, 5 aa, Artificial Sequence
  Description of Artificial Sequence: Synthetic peptide
GYFWN

SEQ ID NO: 2314 - protein, 16 aa, Artificial Sequence
  Description of Artificial Sequence: Synthetic peptide
YIFYSGSTNYNPSLKS

SEQ ID NO: 2315 - protein, 12 aa, Artificial Sequence
  Description of Artificial Sequence: Synthetic peptide
LGKWELRTAFDI

SEQ ID NO: 2316 - protein, 13 aa, Artificial Sequence
  Description of Artificial Sequence: Synthetic peptide
SGSTSNIGSDTVN

SEQ ID NO: 2317 - protein, 7 aa, Artificial Sequence
  Description of Artificial Sequence: Synthetic peptide
SNNQRPS

SEQ ID NO: 2318 - protein, 11 aa, Artificial Sequence
  Description of Artificial Sequence: Synthetic peptide
AAWDDSLNGPV

SEQ ID NO: 2319 - protein, 7 aa, Artificial Sequence
  Description of Artificial Sequence: Synthetic peptide
NGSISGY

SEQ ID NO: 2320 - protein, 5 aa, Artificial Sequence
  Description of Artificial Sequence: Synthetic peptide
FYSGS

SEQ ID NO: 2321 - protein, 11 aa, Artificial Sequence
  Description of Artificial Sequence: Synthetic peptide
LGKWELRTAFD

SEQ ID NO: 2322 - protein, 9 aa, Artificial Sequence
  Description of Artificial Sequence: Synthetic peptide
STSNIGSDT

SEQ ID NO: 2323 - protein, 3 aa, Artificial Sequence
  Description of Artificial Sequence: Synthetic peptide
SNN

SEQ ID NO: 2324 - protein, 8 aa, Artificial Sequence
  Description of Artificial Sequence: Synthetic peptide
WDDSLNGP

SEQ ID NO: 2325 - protein, 10 aa, Artificial Sequence
  Description of Artificial Sequence: Synthetic peptide
NGSISGYFWN

SEQ ID NO: 2326 - protein, 9 aa, Artificial Sequence
  Description of Artificial Sequence: Synthetic peptide
YIFYSGSTN

SEQ ID NO: 2327 - protein, 12 aa, Artificial Sequence
  Description of Artificial Sequence: Synthetic peptide
LGKWELRTAFDI

SEQ ID NO: 2328 - protein, 13 aa, Artificial Sequence
  Description of Artificial Sequence: Synthetic peptide
SGSTSNIGSDTVN

SEQ ID NO: 2329 - protein, 7 aa, Artificial Sequence
  Description of Artificial Sequence: Synthetic peptide
SNNQRPS

SEQ ID NO: 2330 - protein, 11 aa, Artificial Sequence
  Description of Artificial Sequence: Synthetic peptide
AAWDDSLNGPV

SEQ ID NO: 2331 - protein, 6 aa, Artificial Sequence
  Description of Artificial Sequence: Synthetic peptide
SGYFWN

SEQ ID NO: 2332 - protein, 12 aa, Artificial Sequence
  Description of Artificial Sequence: Synthetic peptide
WIGYIFYSGSTN

SEQ ID NO: 2333 - protein, 13 aa, Artificial Sequence
  Description of Artificial Sequence: Synthetic peptide
AKLGKWELRTAFD

SEQ ID NO: 2334 - protein, 9 aa, Artificial Sequence
  Description of Artificial Sequence: Synthetic peptide
IGSDTVNWY

SEQ ID NO: 2335 - protein, 10 aa, Artificial Sequence
  Description of Artificial Sequence: Synthetic peptide
LLIYSNNQRP

SEQ ID NO: 2336 - protein, 10 aa, Artificial Sequence
  Description of Artificial Sequence: Synthetic peptide
AAWDDSLNGP

SEQ ID NO: 2337 - protein, 8 aa, Artificial Sequence
  Description of Artificial Sequence: Synthetic peptide
NGSISGYF

SEQ ID NO: 2338 - protein, 7 aa, Artificial Sequence
  Description of Artificial Sequence: Synthetic peptide
IFYSGST

SEQ ID NO: 2339 - protein, 14 aa, Artificial Sequence
  Description of Artificial Sequence: Synthetic peptide
AKLGKWELRTAFDI

SEQ ID NO: 2340 - protein, 8 aa, Artificial Sequence
  Description of Artificial Sequence: Synthetic peptide
TSNIGSDT

SEQ ID NO: 2341 - protein, 3 aa, Artificial Sequence
  Description of Artificial Sequence: Synthetic peptide
SNN

SEQ ID NO: 2342 - protein, 11 aa, Artificial Sequence
  Description of Artificial Sequence: Synthetic peptide
AAWDDSLNGPV

SEQ ID NO: 2343 - protein, 120 aa, Artificial Sequence
  Description of Artificial Sequence: Synthetic polypeptide
QVQLQESGPGLMKPSETLSLTCTVSNGSISGYFWNWIRQPPGKGLEWIGYIFYSGSTNYNPSLKSRVTISVDTSKNLVSLKLNSVTAADTAVYFCAKLGKWELRTAFDIWGQGTMVTVSS

SEQ ID NO: 2344 - protein, 110 aa, Artificial Sequence
  Description of Artificial Sequence: Synthetic polypeptide
QLVLTQPPSASGTPGQRVTISCSGSTSNIGSDTVNWYQQLPGTAPKLLIYSNNQRPSGVPDRFSGSKSGTSASLAISGLQSEDETDYYCAAWDDSLNGPVFGGGTKVTVL

SEQ ID NO: 2345 - protein, 450 aa, Artificial Sequence
  Description of Artificial Sequence: Synthetic polypeptide
QVQLQESGPGLMKPSETLSLTCTVSNGSISGYFWNWIRQPPGKGLEWIGYIFYSGSTNYNPSLKSRVTISVDTSKNLVSLKLNSVTAADTAVYFCAKLGKWELRTAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2346 - protein, 216 aa, Artificial Sequence
  Description of Artificial Sequence: Synthetic polypeptide
QLVLTQPPSASGTPGQRVTISCSGSTSNIGSDTVNWYQQLPGTAPKLLIYSNNQRPSGVPDRFSGSKSGTSASLAISGLQSEDETDYYCAAWDDSLNGPVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2347 - protein, 5 aa, Artificial Sequence
  Description of Artificial Sequence: Synthetic peptide
GYFWN

SEQ ID NO: 2348 - protein, 16 aa, Artificial Sequence
  Description of Artificial Sequence: Synthetic peptide
YIFYSGSTNYNPSLKS

SEQ ID NO: 2349 - protein, 12 aa, Artificial Sequence
  Description of Artificial Sequence: Synthetic peptide
LGKWELRTAFDI

SEQ ID NO: 2350 - protein, 11 aa, Artificial Sequence
  Description of Artificial Sequence: Synthetic peptide
SGDKLGDKYAC

SEQ ID NO: 2351 - protein, 7 aa, Artificial Sequence
  Description of Artificial Sequence: Synthetic peptide
QDSKRPS

SEQ ID NO: 2352 - protein, 9 aa, Artificial Sequence
  Description of Artificial Sequence: Synthetic peptide
QAWDSSTVV

SEQ ID NO: 2353 - protein, 7 aa, Artificial Sequence
  Description of Artificial Sequence: Synthetic peptide
NGSISGY

SEQ ID NO: 2354 - protein, 5 aa, Artificial Sequence
  Description of Artificial Sequence: Synthetic peptide
FYSGS

SEQ ID NO: 2355 - protein, 11 aa, Artificial Sequence
  Description of Artificial Sequence: Synthetic peptide
LGKWELRTAFD

SEQ ID NO: 2356 - protein, 7 aa, Artificial Sequence
  Description of Artificial Sequence: Synthetic peptide
DKLGDKY

SEQ ID NO: 2357 - protein, 3 aa, Artificial Sequence
  Description of Artificial Sequence: Synthetic peptide
QDS

SEQ ID NO: 2358 - protein, 6 aa, Artificial Sequence
  Description of Artificial Sequence: Synthetic peptide
WDSSTV

SEQ ID NO: 2359 - protein, 10 aa, Artificial Sequence
  Description of Artificial Sequence: Synthetic peptide
NGSISGYFWN

SEQ ID NO: 2360 - protein, 9 aa, Artificial Sequence
  Description of Artificial Sequence: Synthetic peptide
YIFYSGSTN

SEQ ID NO: 2361 - protein, 12 aa, Artificial Sequence
  Description of Artificial Sequence: Synthetic peptide
LGKWELRTAFDI

SEQ ID NO: 2362 - protein, 11 aa, Artificial Sequence
  Description of Artificial Sequence: Synthetic peptide
SGDKLGDKYAC

SEQ ID NO: 2363 - protein, 7 aa, Artificial Sequence
  Description of Artificial Sequence: Synthetic peptide
QDSKRPS

SEQ ID NO: 2364 - protein, 9 aa, Artificial Sequence
  Description of Artificial Sequence: Synthetic peptide
QAWDSSTVV

SEQ ID NO: 2365 - protein, 6 aa, Artificial Sequence
  Description of Artificial Sequence: Synthetic peptide
SGYFWN

SEQ ID NO: 2366 - protein, 12 aa, Artificial Sequence
  Description of Artificial Sequence: Synthetic peptide
WIGYIFYSGSTN

SEQ ID NO: 2367 - protein, 13 aa, Artificial Sequence
  Description of Artificial Sequence: Synthetic peptide
AKLGKWELRTAFD

SEQ ID NO: 2368 - protein, 7 aa, Artificial Sequence
  Description of Artificial Sequence: Synthetic peptide
DKYACWY

SEQ ID NO: 2369 - protein, 10 aa, Artificial Sequence
  Description of Artificial Sequence: Synthetic peptide
LVIYQDSKRP

SEQ ID NO: 2370 - protein, 8 aa, Artificial Sequence
  Description of Artificial Sequence: Synthetic peptide
QAWDSSTV

SEQ ID NO: 2371 - protein, 8 aa, Artificial Sequence
  Description of Artificial Sequence: Synthetic peptide
NGSISGYF

SEQ ID NO: 2372 - protein, 7 aa, Artificial Sequence
  Description of Artificial Sequence: Synthetic peptide
IFYSGST

SEQ ID NO: 2373 - protein, 14 aa, Artificial Sequence
  Description of Artificial Sequence: Synthetic peptide
AKLGKWELRTAFDI

SEQ ID NO: 2374 - protein, 6 aa, Artificial Sequence
  Description of Artificial Sequence: Synthetic peptide
KLGDKY

SEQ ID NO: 2375 - protein, 3 aa, Artificial Sequence
  Description of Artificial Sequence: Synthetic peptide
QDS

SEQ ID NO: 2376 - protein, 9 aa, Artificial Sequence
  Description of Artificial Sequence: Synthetic peptide
QAWDSSTVV

SEQ ID NO: 2377 - protein, 120 aa, Artificial Sequence
  Description of Artificial Sequence: Synthetic polypeptide
QVQLVQSGPGLMKPSETLSLTCTVSNGSISGYFWNWIRQPPGKGLEWIGYIFYSGSTNYNPSLKSRVTISVDTSKNLVSLKLNSVTAADTAVYFCAKLGKWELRTAFDIWGQGTMVTVSS

SEQ ID NO: 2378 - protein, 106 aa, Artificial Sequence
  Description of Artificial Sequence: Synthetic polypeptide
SSELTQPPSVSVSPGQTASITCSGDKLGDKYACWYQQKPGQSPVLVIYQDSKRPSGIPERFSGSNSGNTATLTISGTQAMDEADYYCQAWDSSTVVFGGGTKLTVL

SEQ ID NO: 2379 - protein, 450 aa, Artificial Sequence
  Description of Artificial Sequence: Synthetic polypeptide
QVQLVQSGPGLMKPSETLSLTCTVSNGSISGYFWNWIRQPPGKGLEWIGYIFYSGSTNYNPSLKSRVTISVDTSKNLVSLKLNSVTAADTAVYFCAKLGKWELRTAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2380 - protein, 212 aa, Artificial Sequence
  Description of Artificial Sequence: Synthetic polypeptide
SSELTQPPSVSVSPGQTASITCSGDKLGDKYACWYQQKPGQSPVLVIYQDSKRPSGIPERFSGSNSGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2381 - protein, 5 aa, Artificial Sequence
  Description of Artificial Sequence: Synthetic peptide
SSYWS

SEQ ID NO: 2382 - protein, 16 aa, Artificial Sequence
  Description of Artificial Sequence: Synthetic peptide
RFYSSGSTSYNPSLKS

SEQ ID NO: 2383 - protein, 10 aa, Artificial Sequence
  Description of Artificial Sequence: Synthetic peptide
YSGSYWYFDL

SEQ ID NO: 2384 - protein, 11 aa, Artificial Sequence
  Description of Artificial Sequence: Synthetic peptide
RASQSVSSYLA

SEQ ID NO: 2385 - protein, 7 aa, Artificial Sequence
  Description of Artificial Sequence: Synthetic peptide
DTSNRAT

SEQ ID NO: 2386 - protein, 9 aa, Artificial Sequence
  Description of Artificial Sequence: Synthetic peptide
QQRSDWLLT

SEQ ID NO: 2387 - protein, 7 aa, Artificial Sequence
  Description of Artificial Sequence: Synthetic peptide
GDSISSS

SEQ ID NO: 2388 - protein, 5 aa, Artificial Sequence
  Description of Artificial Sequence: Synthetic peptide
YSSGS

SEQ ID NO: 2389 - protein, 9 aa, Artificial Sequence
  Description of Artificial Sequence: Synthetic peptide
YSGSYWYFD

SEQ ID NO: 2390 - protein, 7 aa, Artificial Sequence
  Description of Artificial Sequence: Synthetic peptide
SQSVSSY

SEQ ID NO: 2391 - protein, 3 aa, Artificial Sequence
  Description of Artificial Sequence: Synthetic peptide
DTS

SEQ ID NO: 2392 - protein, 6 aa, Artificial Sequence
  Description of Artificial Sequence: Synthetic peptide
RSDWLL

SEQ ID NO: 2393 - protein, 10 aa, Artificial Sequence
  Description of Artificial Sequence: Synthetic peptide
GDSISSSYWS

SEQ ID NO: 2394 - protein, 9 aa, Artificial Sequence
  Description of Artificial Sequence: Synthetic peptide
RFYSSGSTS

SEQ ID NO: 2395 - protein, 10 aa, Artificial Sequence
  Description of Artificial Sequence: Synthetic peptide
YSGSYWYFDL

SEQ ID NO: 2396 - protein, 11 aa, Artificial Sequence
  Description of Artificial Sequence: Synthetic peptide
RASQSVSSYLA

SEQ ID NO: 2397 - protein, 7 aa, Artificial Sequence
  Description of Artificial Sequence: Synthetic peptide
DTSNRAT

SEQ ID NO: 2398 - protein, 9 aa, Artificial Sequence
  Description of Artificial Sequence: Synthetic peptide
QQRSDWLLT

SEQ ID NO: 2399 - protein, 6 aa, Artificial Sequence
  Description of Artificial Sequence: Synthetic peptide
SSSYWS

SEQ ID NO: 2400 - protein, 12 aa, Artificial Sequence
  Description of Artificial Sequence: Synthetic peptide
CIGRFYSSGSTS

SEQ ID NO: 2401 - protein, 11 aa, Artificial Sequence
  Description of Artificial Sequence: Synthetic peptide
ARYSGSYWYFD

SEQ ID NO: 2402 - protein, 7 aa, Artificial Sequence
  Description of Artificial Sequence: Synthetic peptide
SSYLAWY

SEQ ID NO: 2403 - protein, 10 aa, Artificial Sequence
  Description of Artificial Sequence: Synthetic peptide
LLIYDTSNRA

SEQ ID NO: 2404 - protein, 8 aa, Artificial Sequence
  Description of Artificial Sequence: Synthetic peptide
QQRSDWLL

SEQ ID NO: 2405 - protein, 8 aa, Artificial Sequence
  Description of Artificial Sequence: Synthetic peptide
GDSISSSY

SEQ ID NO: 2406 - protein, 7 aa, Artificial Sequence
  Description of Artificial Sequence: Synthetic peptide
FYSSGST

SEQ ID NO: 2407 - protein, 12 aa, Artificial Sequence
  Description of Artificial Sequence: Synthetic peptide
ARYSGSYWYFDL

SEQ ID NO: 2408 - protein, 6 aa, Artificial Sequence
  Description of Artificial Sequence: Synthetic peptide
QSVSSY

SEQ ID NO: 2409 - protein, 3 aa, Artificial Sequence
  Description of Artificial Sequence: Synthetic peptide
DTS

SEQ ID NO: 2410 - protein, 9 aa, Artificial Sequence
  Description of Artificial Sequence: Synthetic peptide
QQRSDWLLT

SEQ ID NO: 2411 - protein, 118 aa, Artificial Sequence
  Description of Artificial Sequence: Synthetic polypeptide
QVQLQESGPGLVKPSETLSLTCTVSGDSISSSYWSWIRQPAGKGLECIGRFYSSGSTSYNPSLKSRVTMAIDTSKNQFSLKLTSVTAADTAVYYCARYSGSYWYFDLWGRGTTVTVSS

SEQ ID NO: 2412 - protein, 107 aa, Artificial Sequence
  Description of Artificial Sequence: Synthetic polypeptide
EIVLTQSPATLSLSPGERATLSCRASQSVSSYLAWYQQRPGQAPRLLIYDTSNRATGIPARFSGSGSGTDFTLTISSLAPEDFAVYYCQQRSDWLLTFGGGTKVEIK

SEQ ID NO: 2413 - protein, 448 aa, Artificial Sequence
  Description of Artificial Sequence: Synthetic polypeptide
QVQLQESGPGLVKPSETLSLTCTVSGDSISSSYWSWIRQPAGKGLECIGRFYSSGSTSYNPSLKSRVTMAIDTSKNQFSLKLTSVTAADTAVYYCARYSGSYWYFDLWGRGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2414 - protein, 214 aa, Artificial Sequence
  Description of Artificial Sequence: Synthetic polypeptide
EIVLTQSPATLSLSPGERATLSCRASQSVSSYLAWYQQRPGQAPRLLIYDTSNRATGIPARFSGSGSGTDFTLTISSLAPEDFAVYYCQQRSDWLLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2415 - protein, 5 aa, Artificial Sequence
  Description of Artificial Sequence: Synthetic peptide
YYFWN

SEQ ID NO: 2416 - protein, 16 aa, Artificial Sequence
  Description of Artificial Sequence: Synthetic peptide
YIYYSGSTNYNPSLKS

SEQ ID NO: 2417 - protein, 12 aa, Artificial Sequence
  Description of Artificial Sequence: Synthetic peptide
EGKWELRTTFDI

SEQ ID NO: 2418 - protein, 13 aa, Artificial Sequence
  Description of Artificial Sequence: Synthetic peptide
SGSSSNIGSNTVN

SEQ ID NO: 2419 - protein, 7 aa, Artificial Sequence
  Description of Artificial Sequence: Synthetic peptide
SNNQRPS

SEQ ID NO: 2420 - protein, 11 aa, Artificial Sequence
  Description of Artificial Sequence: Synthetic peptide
AAWDDSLNGPV

SEQ ID NO: 2421 - protein, 7 aa, Artificial Sequence
  Description of Artificial Sequence: Synthetic peptide
GGSISYY

SEQ ID NO: 2422 - protein, 5 aa, Artificial Sequence
  Description of Artificial Sequence: Synthetic peptide
YYSGS

SEQ ID NO: 2423 - protein, 11 aa, Artificial Sequence
  Description of Artificial Sequence: Synthetic peptide
EGKWELRTTFD

SEQ ID NO: 2424 - protein, 9 aa, Artificial Sequence
  Description of Artificial Sequence: Synthetic peptide
SSSNIGSNT

SEQ ID NO: 2425 - protein, 3 aa, Artificial Sequence
  Description of Artificial Sequence: Synthetic peptide
SNN

SEQ ID NO: 2426 - protein, 8 aa, Artificial Sequence
  Description of Artificial Sequence: Synthetic peptide
WDDSLNGP

SEQ ID NO: 2427 - protein, 10 aa, Artificial Sequence
  Description of Artificial Sequence: Synthetic peptide
GGSISYYFWN

SEQ ID NO: 2428 - protein, 9 aa, Artificial Sequence
  Description of Artificial Sequence: Synthetic peptide
YIYYSGSTN

SEQ ID NO: 2429 - protein, 12 aa, Artificial Sequence
  Description of Artificial Sequence: Synthetic peptide
EGKWELRTTFDI

SEQ ID NO: 2430 - protein, 13 aa, Artificial Sequence
  Description of Artificial Sequence: Synthetic peptide
SGSSSNIGSNTVN

SEQ ID NO: 2431 - protein, 7 aa, Artificial Sequence
  Description of Artificial Sequence: Synthetic peptide
SNNQRPS

SEQ ID NO: 2432 - protein, 11 aa, Artificial Sequence
  Description of Artificial Sequence: Synthetic peptide
AAWDDSLNGPV

SEQ ID NO: 2433 - protein, 6 aa, Artificial Sequence
  Description of Artificial Sequence: Synthetic peptide
SYYFWN

SEQ ID NO: 2434 - protein, 12 aa, Artificial Sequence
  Description of Artificial Sequence: Synthetic peptide
WIGYIYYSGSTN

SEQ ID NO: 2435 - protein, 13 aa, Artificial Sequence
  Description of Artificial Sequence: Synthetic peptide
AREGKWELRTTFD

SEQ ID NO: 2436 - protein, 9 aa, Artificial Sequence
  Description of Artificial Sequence: Synthetic peptide
IGSNTVNWY

SEQ ID NO: 2437 - protein, 10 aa, Artificial Sequence
  Description of Artificial Sequence: Synthetic peptide
LLIYSNNQRP

SEQ ID NO: 2438 - protein, 10 aa, Artificial Sequence
  Description of Artificial Sequence: Synthetic peptide
AAWDDSLNGP

SEQ ID NO: 2439 - protein, 8 aa, Artificial Sequence
  Description of Artificial Sequence: Synthetic peptide
GGSISYYF

SEQ ID NO: 2440 - protein, 7 aa, Artificial Sequence
  Description of Artificial Sequence: Synthetic peptide
IYYSGST

SEQ ID NO: 2441 - protein, 14 aa, Artificial Sequence
  Description of Artificial Sequence: Synthetic peptide
AREGKWELRTTFDI

SEQ ID NO: 2442 - protein, 8 aa, Artificial Sequence
  Description of Artificial Sequence: Synthetic peptide
SSNIGSNT

SEQ ID NO: 2443 - protein, 3 aa, Artificial Sequence
  Description of Artificial Sequence: Synthetic peptide
SNN

SEQ ID NO: 2444 - protein, 11 aa, Artificial Sequence
  Description of Artificial Sequence: Synthetic peptide
AAWDDSLNGPV

SEQ ID NO: 2445 - protein, 120 aa, Artificial Sequence
  Description of Artificial Sequence: Synthetic polypeptide
QVQLQESGPGLVKPSETLSLTCTVSGGSISYYFWNWIRQPPGKGLEWIGYIYYSGSTNYNPSLKSRVTISLDTSKNQFSLKLSSVTAADTAVYYCAREGKWELRTTFDIWGQGTMVTVSS

SEQ ID NO: 2446 - protein, 110 aa, Artificial Sequence
  Description of Artificial Sequence: Synthetic polypeptide
QSALTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVFGGGTKLTVL

SEQ ID NO: 2447 - protein, 450 aa, Artificial Sequence
  Description of Artificial Sequence: Synthetic polypeptide
QVQLQESGPGLVKPSETLSLTCTVSGGSISYYFWNWIRQPPGKGLEWIGYIYYSGSTNYNPSLKSRVTISLDTSKNQFSLKLSSVTAADTAVYYCAREGKWELRTTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2448 - protein, 216 aa, Artificial Sequence
  Description of Artificial Sequence: Synthetic polypeptide
QSALTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2449 - protein, 5 aa, Artificial Sequence
  Description of Artificial Sequence: Synthetic peptide
SYYWS

SEQ ID NO: 2450 - protein, 16 aa, Artificial Sequence
  Description of Artificial Sequence: Synthetic peptide
RFYTGGRNNYNPSFKS

SEQ ID NO: 2451 - protein, 18 aa, Artificial Sequence
  Description of Artificial Sequence: Synthetic peptide
DMEYYYDRSGYSYWYFDL

SEQ ID NO: 2452 - protein, 11 aa, Artificial Sequence
  Description of Artificial Sequence: Synthetic peptide
GGNNIGSKSVH

SEQ ID NO: 2453 - protein, 7 aa, Artificial Sequence
  Description of Artificial Sequence: Synthetic peptide
DDSDRPS

SEQ ID NO: 2454 - protein, 11 aa, Artificial Sequence
  Description of Artificial Sequence: Synthetic peptide
QVWDSSSDHVV

SEQ ID NO: 2455 - protein, 7 aa, Artificial Sequence
  Description of Artificial Sequence: Synthetic peptide
GGSISSY

SEQ ID NO: 2456 - protein, 5 aa, Artificial Sequence
  Description of Artificial Sequence: Synthetic peptide
YTGGR

SEQ ID NO: 2457 - protein, 17 aa, Artificial Sequence
  Description of Artificial Sequence: Synthetic peptide
DMEYYYDRSGYSYWYFD

SEQ ID NO: 2458 - protein, 7 aa, Artificial Sequence
  Description of Artificial Sequence: Synthetic peptide
NNIGSKS

SEQ ID NO: 2459 - protein, 3 aa, Artificial Sequence
  Description of Artificial Sequence: Synthetic peptide
DDS

SEQ ID NO: 2460 - protein, 8 aa, Artificial Sequence
  Description of Artificial Sequence: Synthetic peptide
WDSSSDHV

SEQ ID NO: 2461 - protein, 10 aa, Artificial Sequence
  Description of Artificial Sequence: Synthetic peptide
GGSISSYYWS

SEQ ID NO: 2462 - protein, 9 aa, Artificial Sequence
  Description of Artificial Sequence: Synthetic peptide
RFYTGGRNN

SEQ ID NO: 2463 - protein, 18 aa, Artificial Sequence
  Description of Artificial Sequence: Synthetic peptide
DMEYYYDRSGYSYWYFDL

SEQ ID NO: 2464 - protein, 11 aa, Artificial Sequence
  Description of Artificial Sequence: Synthetic peptide
GGNNIGSKSVH

SEQ ID NO: 2465 - protein, 7 aa, Artificial Sequence
  Description of Artificial Sequence: Synthetic peptide
DDSDRPS

SEQ ID NO: 2466 - protein, 11 aa, Artificial Sequence
  Description of Artificial Sequence: Synthetic peptide
QVWDSSSDHVV

SEQ ID NO: 2467 - protein, 6 aa, Artificial Sequence
  Description of Artificial Sequence: Synthetic peptide
SSYYWS

SEQ ID NO: 2468 - protein, 12 aa, Artificial Sequence
  Description of Artificial Sequence: Synthetic peptide
WIGRFYTGGRNN

SEQ ID NO: 2469 - protein, 19 aa, Artificial Sequence
  Description of Artificial Sequence: Synthetic peptide
ARDMEYYYDRSGYSYWYFD

SEQ ID NO: 2470 - protein, 7 aa, Artificial Sequence
  Description of Artificial Sequence: Synthetic peptide
SKSVHWY

SEQ ID NO: 2471 - protein, 10 aa, Artificial Sequence
  Description of Artificial Sequence: Synthetic peptide
LVVYDDSDRP

SEQ ID NO: 2472 - protein, 10 aa, Artificial Sequence
  Description of Artificial Sequence: Synthetic peptide
QVWDSSSDHV

SEQ ID NO: 2473 - protein, 8 aa, Artificial Sequence
  Description of Artificial Sequence: Synthetic peptide
GGSISSYY

SEQ ID NO: 2474 - protein, 7 aa, Artificial Sequence
  Description of Artificial Sequence: Synthetic peptide
FYTGGRN

SEQ ID NO: 2475 - protein, 20 aa, Artificial Sequence
  Description of Artificial Sequence: Synthetic peptide
ARDMEYYYDRSGYSYWYFDL

SEQ ID NO: 2476 - protein, 6 aa, Artificial Sequence
  Description of Artificial Sequence: Synthetic peptide
NIGSKS

SEQ ID NO: 2477 - protein, 3 aa, Artificial Sequence
  Description of Artificial Sequence: Synthetic peptide
DDS

SEQ ID NO: 2478 - protein, 11 aa, Artificial Sequence
  Description of Artificial Sequence: Synthetic peptide
QVWDSSSDHVV

SEQ ID NO: 2479 - protein, 126 aa, Artificial Sequence
  Description of Artificial Sequence: Synthetic polypeptide
EVQLVQSGPGLVKPSETLSLTCTVSGGSISSYYWSWIRQPAGKGLEWIGRFYTGGRNNYNPSFKSRVTMSVDTSQNQFSLKLSSVTAADTAVYYCARDMEYYYDRSGYSYWYFDLWGRGTTVTVSS

SEQ ID NO: 2480 - protein, 108 aa, Artificial Sequence
  Description of Artificial Sequence: Synthetic polypeptide
SYELMQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVL

SEQ ID NO: 2481 - protein, 456 aa, Artificial Sequence
  Description of Artificial Sequence: Synthetic polypeptide
EVQLVQSGPGLVKPSETLSLTCTVSGGSISSYYWSWIRQPAGKGLEWIGRFYTGGRNNYNPSFKSRVTMSVDTSQNQFSLKLSSVTAADTAVYYCARDMEYYYDRSGYSYWYFDLWGRGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2482 - protein, 214 aa, Artificial Sequence
  Description of Artificial Sequence: Synthetic polypeptide
SYELMQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2483 - protein, 5 aa, Artificial Sequence
  Description of Artificial Sequence: Synthetic peptide
SYYWN

SEQ ID NO: 2484 - protein, 16 aa, Artificial Sequence
  Description of Artificial Sequence: Synthetic peptide
RIYTIGNTNYNPSLKS

SEQ ID NO: 2485 - protein, 17 aa, Artificial Sequence
  Description of Artificial Sequence: Synthetic peptide
EGYYESDGSFFPGAFNI

SEQ ID NO: 2486 - protein, 14 aa, Artificial Sequence
  Description of Artificial Sequence: Synthetic peptide
TGTSNDVGSYNLVS

SEQ ID NO: 2487 - protein, 7 aa, Artificial Sequence
  Description of Artificial Sequence: Synthetic peptide
AGSKRPS

SEQ ID NO: 2488 - protein, 10 aa, Artificial Sequence
  Description of Artificial Sequence: Synthetic peptide
CSYAGTTNVV

SEQ ID NO: 2489 - protein, 7 aa, Artificial Sequence
  Description of Artificial Sequence: Synthetic peptide
GGSITSY

SEQ ID NO: 2490 - protein, 5 aa, Artificial Sequence
  Description of Artificial Sequence: Synthetic peptide
YTIGN

SEQ ID NO: 2491 - protein, 16 aa, Artificial Sequence
  Description of Artificial Sequence: Synthetic peptide
EGYYESDGSFFPGAFN

SEQ ID NO: 2492 - protein, 10 aa, Artificial Sequence
  Description of Artificial Sequence: Synthetic peptide
TSNDVGSYNL

SEQ ID NO: 2493 - protein, 3 aa, Artificial Sequence
  Description of Artificial Sequence: Synthetic peptide
AGS

SEQ ID NO: 2494 - protein, 7 aa, Artificial Sequence
  Description of Artificial Sequence: Synthetic peptide
YAGTTNV

SEQ ID NO: 2495 - protein, 10 aa, Artificial Sequence
  Description of Artificial Sequence: Synthetic peptide
GGSITSYYWN

SEQ ID NO: 2496 - protein, 9 aa, Artificial Sequence
  Description of Artificial Sequence: Synthetic peptide
RIYTIGNTN

SEQ ID NO: 2497 - protein, 17 aa, Artificial Sequence
  Description of Artificial Sequence: Synthetic peptide
EGYYESDGSFFPGAFNI

SEQ ID NO: 2498 - protein, 14 aa, Artificial Sequence
  Description of Artificial Sequence: Synthetic peptide
TGTSNDVGSYNLVS

SEQ ID NO: 2499 - protein, 7 aa, Artificial Sequence
  Description of Artificial Sequence: Synthetic peptide
AGSKRPS

SEQ ID NO: 2500 - protein, 10 aa, Artificial Sequence
  Description of Artificial Sequence: Synthetic peptide
CSYAGTTNVV

SEQ ID NO: 2501 - protein, 6 aa, Artificial Sequence
  Description of Artificial Sequence: Synthetic peptide
TSYYWN

SEQ ID NO: 2502 - protein, 12 aa, Artificial Sequence
  Description of Artificial Sequence: Synthetic peptide
WIGRIYTIGNTN

SEQ ID NO: 2503 - protein, 18 aa, Artificial Sequence
  Description of Artificial Sequence: Synthetic peptide
AREGYYESDGSFFPGAFN

SEQ ID NO: 2504 - protein, 10 aa, Artificial Sequence
  Description of Artificial Sequence: Synthetic peptide
VGSYNLVSWY

SEQ ID NO: 2505 - protein, 10 aa, Artificial Sequence
  Description of Artificial Sequence: Synthetic peptide
LMIYAGSKRP

SEQ ID NO: 2506 - protein, 9 aa, Artificial Sequence
  Description of Artificial Sequence: Synthetic peptide
CSYAGTTNV

SEQ ID NO: 2507 - protein, 8 aa, Artificial Sequence
  Description of Artificial Sequence: Synthetic peptide
GGSITSYY

SEQ ID NO: 2508 - protein, 7 aa, Artificial Sequence
  Description of Artificial Sequence: Synthetic peptide
IYTIGNT

SEQ ID NO: 2509 - protein, 19 aa, Artificial Sequence
  Description of Artificial Sequence: Synthetic peptide
AREGYYESDGSFFPGAFNI

SEQ ID NO: 2510 - protein, 9 aa, Artificial Sequence
  Description of Artificial Sequence: Synthetic peptide
SNDVGSYNL

SEQ ID NO: 2511 - protein, 3 aa, Artificial Sequence
  Description of Artificial Sequence: Synthetic peptide
AGS

SEQ ID NO: 2512 - protein, 10 aa, Artificial Sequence
  Description of Artificial Sequence: Synthetic peptide
CSYAGTTNVV

SEQ ID NO: 2513 - protein, 125 aa, Artificial Sequence
  Description of Artificial Sequence: Synthetic polypeptide
QVQLQQSGPGLVKPSETLSLTCTVSGGSITSYYWNWIRQPAGKGLEWIGRIYTIGNTNYNPSLKSRVTMSIDTSKHQFSLKLSSVTGADTAVYYCAREGYYESDGSFFPGAFNIWGQGTMVTVSS

SEQ ID NO: 2514 - protein, 110 aa, Artificial Sequence
  Description of Artificial Sequence: Synthetic polypeptide
SSELTQPASVSGSPGQSITISCTGTSNDVGSYNLVSWYQQHPGKAPKLMIYAGSKRPSGISNRFSGSKSGNTASLTISGLQAEDEADYYCCSYAGTTNVVFGGGTKVTVL

SEQ ID NO: 2515 - protein, 455 aa, Artificial Sequence
  Description of Artificial Sequence: Synthetic polypeptide
QVQLQQSGPGLVKPSETLSLTCTVSGGSITSYYWNWIRQPAGKGLEWIGRIYTIGNTNYNPSLKSRVTMSIDTSKHQFSLKLSSVTGADTAVYYCAREGYYESDGSFFPGAFNIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2516 - protein, 216 aa, Artificial Sequence
  Description of Artificial Sequence: Synthetic polypeptide
SSELTQPASVSGSPGQSITISCTGTSNDVGSYNLVSWYQQHPGKAPKLMIYAGSKRPSGISNRFSGSKSGNTASLTISGLQAEDEADYYCCSYAGTTNVVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2517 - protein, 5 aa, Artificial Sequence
  Description of Artificial Sequence: Synthetic peptide
GDYMH

SEQ ID NO: 2518 - protein, 17 aa, Artificial Sequence
  Description of Artificial Sequence: Synthetic peptide
WINPNSGYTNNAEKFQG

SEQ ID NO: 2519 - protein, 7 aa, Artificial Sequence
  Description of Artificial Sequence: Synthetic peptide
ELDALDV

SEQ ID NO: 2520 - protein, 14 aa, Artificial Sequence
  Description of Artificial Sequence: Synthetic peptide
TGTSSDVGGYNYVS

SEQ ID NO: 2521 - protein, 7 aa, Artificial Sequence
  Description of Artificial Sequence: Synthetic peptide
EVSKRPS

SEQ ID NO: 2522 - protein, 11 aa, Artificial Sequence
  Description of Artificial Sequence: Synthetic peptide
NSYAGSNNFEV

SEQ ID NO: 2523 - protein, 7 aa, Artificial Sequence
  Description of Artificial Sequence: Synthetic peptide
GYTFTGD

SEQ ID NO: 2524 - protein, 6 aa, Artificial Sequence
  Description of Artificial Sequence: Synthetic peptide
NPNSGY

SEQ ID NO: 2525 - protein, 6 aa, Artificial Sequence
  Description of Artificial Sequence: Synthetic peptide
ELDALD

SEQ ID NO: 2526 - protein, 10 aa, Artificial Sequence
  Description of Artificial Sequence: Synthetic peptide
TSSDVGGYNY

SEQ ID NO: 2527 - protein, 3 aa, Artificial Sequence
  Description of Artificial Sequence: Synthetic peptide
EVS

SEQ ID NO: 2528 - protein, 8 aa, Artificial Sequence
  Description of Artificial Sequence: Synthetic peptide
YAGSNNFE

SEQ ID NO: 2529 - protein, 10 aa, Artificial Sequence
  Description of Artificial Sequence: Synthetic peptide
GYTFTGDYMH

SEQ ID NO: 2530 - protein, 10 aa, Artificial Sequence
  Description of Artificial Sequence: Synthetic peptide
WINPNSGYTN

SEQ ID NO: 2531 - protein, 7 aa, Artificial Sequence
  Description of Artificial Sequence: Synthetic peptide
ELDALDV

SEQ ID NO: 2532 - protein, 14 aa, Artificial Sequence
  Description of Artificial Sequence: Synthetic peptide
TGTSSDVGGYNYVS

SEQ ID NO: 2533 - protein, 7 aa, Artificial Sequence
  Description of Artificial Sequence: Synthetic peptide
EVSKRPS

SEQ ID NO: 2534 - protein, 11 aa, Artificial Sequence
  Description of Artificial Sequence: Synthetic peptide
NSYAGSNNFEV

SEQ ID NO: 2535 - protein, 6 aa, Artificial Sequence
  Description of Artificial Sequence: Synthetic peptide
TGDYMH

SEQ ID NO: 2536 - protein, 13 aa, Artificial Sequence
  Description of Artificial Sequence: Synthetic peptide
WMGWINPNSGYTN

SEQ ID NO: 2537 - protein, 8 aa, Artificial Sequence
  Description of Artificial Sequence: Synthetic peptide
TRELDALD

SEQ ID NO: 2538 - protein, 10 aa, Artificial Sequence
  Description of Artificial Sequence: Synthetic peptide
VGGYNYVSWY

SEQ ID NO: 2539 - protein, 10 aa, Artificial Sequence
  Description of Artificial Sequence: Synthetic peptide
LMIYEVSKRP

SEQ ID NO: 2540 - protein, 10 aa, Artificial Sequence
  Description of Artificial Sequence: Synthetic peptide
NSYAGSNNFE

SEQ ID NO: 2541 - protein, 8 aa, Artificial Sequence
  Description of Artificial Sequence: Synthetic peptide
GYTFTGDY

SEQ ID NO: 2542 - protein, 8 aa, Artificial Sequence
  Description of Artificial Sequence: Synthetic peptide
INPNSGYT

SEQ ID NO: 2543 - protein, 9 aa, Artificial Sequence
  Description of Artificial Sequence: Synthetic peptide
TRELDALDV

SEQ ID NO: 2544 - protein, 9 aa, Artificial Sequence
  Description of Artificial Sequence: Synthetic peptide
SSDVGGYNY

SEQ ID NO: 2545 - protein, 3 aa, Artificial Sequence
  Description of Artificial Sequence: Synthetic peptide
EVS

SEQ ID NO: 2546 - protein, 11 aa, Artificial Sequence
  Description of Artificial Sequence: Synthetic peptide
NSYAGSNNFEV

SEQ ID NO: 2547 - protein, 116 aa, Artificial Sequence
  Description of Artificial Sequence: Synthetic polypeptide
EVQLLESGAEVKKPGASVKVSCKASGYTFTGDYMHWVRQAPGQGLEWMGWINPNSGYTNNAEKFQGRVTMTRDTSISTAYMELSRLSSDDTAVYYCTRELDALDVWGQGTMVTVSS

SEQ ID NO: 2548 - protein, 111 aa, Artificial Sequence
  Description of Artificial Sequence: Synthetic polypeptide
QSVLTQPPSASGSPGQSVTISCTGTSSDVGGYNYVSWYQQHPGKAPKLMIYEVSKRPSGVPDRFSGSKSGNTASLTVSGLQAEDEADYYCNSYAGSNNFEVFGGGTKVTVL

SEQ ID NO: 2549 - protein, 446 aa, Artificial Sequence
  Description of Artificial Sequence: Synthetic polypeptide
EVQLLESGAEVKKPGASVKVSCKASGYTFTGDYMHWVRQAPGQGLEWMGWINPNSGYTNNAEKFQGRVTMTRDTSISTAYMELSRLSSDDTAVYYCTRELDALDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2550 - protein, 217 aa, Artificial Sequence
  Description of Artificial Sequence: Synthetic polypeptide
QSVLTQPPSASGSPGQSVTISCTGTSSDVGGYNYVSWYQQHPGKAPKLMIYEVSKRPSGVPDRFSGSKSGNTASLTVSGLQAEDEADYYCNSYAGSNNFEVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2551 - protein, 5 aa, Artificial Sequence
  Description of Artificial Sequence: Synthetic peptide
NHFWS

SEQ ID NO: 2552 - protein, 16 aa, Artificial Sequence
  Description of Artificial Sequence: Synthetic peptide
FVFYNGNTNYNPSLKS

SEQ ID NO: 2553 - protein, 12 aa, Artificial Sequence
  Description of Artificial Sequence: Synthetic peptide
VGRWVLRTAFDI

SEQ ID NO: 2554 - protein, 13 aa, Artificial Sequence
  Description of Artificial Sequence: Synthetic peptide
SGSSSNIGSNTVN

SEQ ID NO: 2555 - protein, 7 aa, Artificial Sequence
  Description of Artificial Sequence: Synthetic peptide
SNNQRPS

SEQ ID NO: 2556 - protein, 12 aa, Artificial Sequence
  Description of Artificial Sequence: Synthetic peptide
AAWDDSLNGPGV

SEQ ID NO: 2557 - protein, 7 aa, Artificial Sequence
  Description of Artificial Sequence: Synthetic peptide
GDSINNH

SEQ ID NO: 2558 - protein, 5 aa, Artificial Sequence
  Description of Artificial Sequence: Synthetic peptide
FYNGN

SEQ ID NO: 2559 - protein, 11 aa, Artificial Sequence
  Description of Artificial Sequence: Synthetic peptide
VGRWVLRTAFD

SEQ ID NO: 2560 - protein, 9 aa, Artificial Sequence
  Description of Artificial Sequence: Synthetic peptide
SSSNIGSNT

SEQ ID NO: 2561 - protein, 3 aa, Artificial Sequence
  Description of Artificial Sequence: Synthetic peptide
SNN

SEQ ID NO: 2562 - protein, 9 aa, Artificial Sequence
  Description of Artificial Sequence: Synthetic peptide
WDDSLNGPG

SEQ ID NO: 2563 - protein, 10 aa, Artificial Sequence
  Description of Artificial Sequence: Synthetic peptide
GDSINNHFWS

SEQ ID NO: 2564 - protein, 9 aa, Artificial Sequence
  Description of Artificial Sequence: Synthetic peptide
FVFYNGNTN

SEQ ID NO: 2565 - protein, 12 aa, Artificial Sequence
  Description of Artificial Sequence: Synthetic peptide
VGRWVLRTAFDI

SEQ ID NO: 2566 - protein, 13 aa, Artificial Sequence
  Description of Artificial Sequence: Synthetic peptide
SGSSSNIGSNTVN

SEQ ID NO: 2567 - protein, 7 aa, Artificial Sequence
  Description of Artificial Sequence: Synthetic peptide
SNNQRPS

SEQ ID NO: 2568 - protein, 12 aa, Artificial Sequence
  Description of Artificial Sequence: Synthetic peptide
AAWDDSLNGPGV

SEQ ID NO: 2569 - protein, 6 aa, Artificial Sequence
  Description of Artificial Sequence: Synthetic peptide
NNHFWS

SEQ ID NO: 2570 - protein, 12 aa, Artificial Sequence
  Description of Artificial Sequence: Synthetic peptide
WIGFVFYNGNTN

SEQ ID NO: 2571 - protein, 13 aa, Artificial Sequence
  Description of Artificial Sequence: Synthetic peptide
ARVGRWVLRTAFD

SEQ ID NO: 2572 - protein, 9 aa, Artificial Sequence
  Description of Artificial Sequence: Synthetic peptide
IGSNTVNWY

SEQ ID NO: 2573 - protein, 10 aa, Artificial Sequence
  Description of Artificial Sequence: Synthetic peptide
LLIYSNNQRP

SEQ ID NO: 2574 - protein, 11 aa, Artificial Sequence
  Description of Artificial Sequence: Synthetic peptide
AAWDDSLNGPG

SEQ ID NO: 2575 - protein, 8 aa, Artificial Sequence
  Description of Artificial Sequence: Synthetic peptide
GDSINNHF

SEQ ID NO: 2576 - protein, 7 aa, Artificial Sequence
  Description of Artificial Sequence: Synthetic peptide
VFYNGNT

SEQ ID NO: 2577 - protein, 14 aa, Artificial Sequence
  Description of Artificial Sequence: Synthetic peptide
ARVGRWVLRTAFDI

SEQ ID NO: 2578 - protein, 8 aa, Artificial Sequence
  Description of Artificial Sequence: Synthetic peptide
SSNIGSNT

SEQ ID NO: 2579 - protein, 3 aa, Artificial Sequence
  Description of Artificial Sequence: Synthetic peptide
SNN

SEQ ID NO: 2580 - protein, 12 aa, Artificial Sequence
  Description of Artificial Sequence: Synthetic peptide
AAWDDSLNGPGV

SEQ ID NO: 2581 - protein, 120 aa, Artificial Sequence
  Description of Artificial Sequence: Synthetic polypeptide
QVQLVESGPGLVKPSETLSLTCTVSGDSINNHFWSWIRQPPGKGLEWIGFVFYNGNTNYNPSLKSRVTISIDTSKSQFSLKLTSVTAADTAVYYCARVGRWVLRTAFDIWGQGTMVTVSS

SEQ ID NO: 2582 - protein, 111 aa, Artificial Sequence
  Description of Artificial Sequence: Synthetic polypeptide
QSALTQPPSASGTPGQRVTISCSGSSSNIGSNTVNWYQQLPGTAPKLLIYSNNQRPSGVPARFSGSKSGTSASLAISGLQSEDEADYYCAAWDDSLNGPGVFGGGTKLTVL

SEQ ID NO: 2583 - protein, 450 aa, Artificial Sequence
  Description of Artificial Sequence: Synthetic polypeptide
QVQLVESGPGLVKPSETLSLTCTVSGDSINNHFWSWIRQPPGKGLEWIGFVFYNGNTNYNPSLKSRVTISIDTSKSQFSLKLTSVTAADTAVYYCARVGRWVLRTAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2584 - protein, 217 aa, Artificial Sequence
  Description of Artificial Sequence: Synthetic polypeptide
QSALTQPPSASGTPGQRVTISCSGSSSNIGSNTVNWYQQLPGTAPKLLIYSNNQRPSGVPARFSGSKSGTSASLAISGLQSEDEADYYCAAWDDSLNGPGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2585 - protein, 5 aa, Artificial Sequence
  Description of Artificial Sequence: Synthetic peptide
NYFWS

SEQ ID NO: 2586 - protein, 16 aa, Artificial Sequence
  Description of Artificial Sequence: Synthetic peptide
YIYYSGSTNYNPSLKS

SEQ ID NO: 2587 - protein, 12 aa, Artificial Sequence
  Description of Artificial Sequence: Synthetic peptide
EGKWELRSAFDI

SEQ ID NO: 2588 - protein, 13 aa, Artificial Sequence
  Description of Artificial Sequence: Synthetic peptide
SGSSSNIESNTVN

SEQ ID NO: 2589 - protein, 7 aa, Artificial Sequence
  Description of Artificial Sequence: Synthetic peptide
SNNQRPS

SEQ ID NO: 2590 - protein, 11 aa, Artificial Sequence
  Description of Artificial Sequence: Synthetic peptide
TAWDDSLNGPV

SEQ ID NO: 2591 - protein, 7 aa, Artificial Sequence
  Description of Artificial Sequence: Synthetic peptide
GGSINNY

SEQ ID NO: 2592 - protein, 5 aa, Artificial Sequence
  Description of Artificial Sequence: Synthetic peptide
YYSGS

SEQ ID NO: 2593 - protein, 11 aa, Artificial Sequence
  Description of Artificial Sequence: Synthetic peptide
EGKWELRSAFD

SEQ ID NO: 2594 - protein, 9 aa, Artificial Sequence
  Description of Artificial Sequence: Synthetic peptide
SSSNIESNT

SEQ ID NO: 2595 - protein, 3 aa, Artificial Sequence
  Description of Artificial Sequence: Synthetic peptide
SNN

SEQ ID NO: 2596 - protein, 8 aa, Artificial Sequence
  Description of Artificial Sequence: Synthetic peptide
WDDSLNGP

SEQ ID NO: 2597 - protein, 10 aa, Artificial Sequence
  Description of Artificial Sequence: Synthetic peptide
GGSINNYFWS

SEQ ID NO: 2598 - protein, 9 aa, Artificial Sequence
  Description of Artificial Sequence: Synthetic peptide
YIYYSGSTN

SEQ ID NO: 2599 - protein, 12 aa, Artificial Sequence
  Description of Artificial Sequence: Synthetic peptide
EGKWELRSAFDI

SEQ ID NO: 2600 - protein, 13 aa, Artificial Sequence
  Description of Artificial Sequence: Synthetic peptide
SGSSSNIESNTVN

SEQ ID NO: 2601 - protein, 7 aa, Artificial Sequence
  Description of Artificial Sequence: Synthetic peptide
SNNQRPS

SEQ ID NO: 2602 - protein, 11 aa, Artificial Sequence
  Description of Artificial Sequence: Synthetic peptide
TAWDDSLNGPV

SEQ ID NO: 2603 - protein, 6 aa, Artificial Sequence
  Description of Artificial Sequence: Synthetic peptide
NNYFWS

SEQ ID NO: 2604 - protein, 12 aa, Artificial Sequence
  Description of Artificial Sequence: Synthetic peptide
WIGYIYYSGSTN

SEQ ID NO: 2605 - protein, 13 aa, Artificial Sequence
  Description of Artificial Sequence: Synthetic peptide
AREGKWELRSAFD

SEQ ID NO: 2606 - protein, 9 aa, Artificial Sequence
  Description of Artificial Sequence: Synthetic peptide
IESNTVNWY

SEQ ID NO: 2607 - protein, 10 aa, Artificial Sequence
  Description of Artificial Sequence: Synthetic peptide
LLIYSNNQRP

SEQ ID NO: 2608 - protein, 10 aa, Artificial Sequence
  Description of Artificial Sequence: Synthetic peptide
TAWDDSLNGP

SEQ ID NO: 2609 - protein, 8 aa, Artificial Sequence
  Description of Artificial Sequence: Synthetic peptide
GGSINNYF

SEQ ID NO: 2610 - protein, 7 aa, Artificial Sequence
  Description of Artificial Sequence: Synthetic peptide
IYYSGST

SEQ ID NO: 2611 - protein, 14 aa, Artificial Sequence
  Description of Artificial Sequence: Synthetic peptide
AREGKWELRSAFDI

SEQ ID NO: 2612 - protein, 8 aa, Artificial Sequence
  Description of Artificial Sequence: Synthetic peptide
SSNIESNT

SEQ ID NO: 2613 - protein, 3 aa, Artificial Sequence
  Description of Artificial Sequence: Synthetic peptide
SNN

SEQ ID NO: 2614 - protein, 11 aa, Artificial Sequence
  Description of Artificial Sequence: Synthetic peptide
TAWDDSLNGPV

SEQ ID NO: 2615 - protein, 120 aa, Artificial Sequence
  Description of Artificial Sequence: Synthetic polypeptide
QVQLQESGPGLVKPSETLSLTCTVSGGSINNYFWSWIRQPPGKGLEWIGYIYYSGSTNYNPSLKSRVTISVVTSMNQFSLKLSSVTAADTAVYYCAREGKWELRSAFDIWGQGTMVTVSS

SEQ ID NO: 2616 - protein, 110 aa, Artificial Sequence
  Description of Artificial Sequence: Synthetic polypeptide
QSVLTQPPSASGTPGQRVTISCSGSSSNIESNTVNWYQQLPRTAPKLLIYSNNQRPSGVPDRFSGSKSGTSASLAISGLQSEDEADYYCTAWDDSLNGPVFGGGTKVTVL

SEQ ID NO: 2617 - protein, 450 aa, Artificial Sequence
  Description of Artificial Sequence: Synthetic polypeptide
QVQLQESGPGLVKPSETLSLTCTVSGGSINNYFWSWIRQPPGKGLEWIGYIYYSGSTNYNPSLKSRVTISVVTSMNQFSLKLSSVTAADTAVYYCAREGKWELRSAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2618 - protein, 216 aa, Artificial Sequence
  Description of Artificial Sequence: Synthetic polypeptide
QSVLTQPPSASGTPGQRVTISCSGSSSNIESNTVNWYQQLPRTAPKLLIYSNNQRPSGVPDRFSGSKSGTSASLAISGLQSEDEADYYCTAWDDSLNGPVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2619 - protein, 5 aa, Artificial Sequence
  Description of Artificial Sequence: Synthetic peptide
SEYIH

SEQ ID NO: 2620 - protein, 17 aa, Artificial Sequence
  Description of Artificial Sequence: Synthetic peptide
IINPSGGSTSYAQRFQG

SEQ ID NO: 2621 - protein, 11 aa, Artificial Sequence
  Description of Artificial Sequence: Synthetic peptide
ERGYSYGSFDY

SEQ ID NO: 2622 - protein, 11 aa, Artificial Sequence
  Description of Artificial Sequence: Synthetic peptide
RASQGISSYLA

SEQ ID NO: 2623 - protein, 7 aa, Artificial Sequence
  Description of Artificial Sequence: Synthetic peptide
AASTLQS

SEQ ID NO: 2624 - protein, 9 aa, Artificial Sequence
  Description of Artificial Sequence: Synthetic peptide
QQFNSYSLT

SEQ ID NO: 2625 - protein, 7 aa, Artificial Sequence
  Description of Artificial Sequence: Synthetic peptide
GYTFTSE

SEQ ID NO: 2626 - protein, 6 aa, Artificial Sequence
  Description of Artificial Sequence: Synthetic peptide
NPSGGS

SEQ ID NO: 2627 - protein, 10 aa, Artificial Sequence
  Description of Artificial Sequence: Synthetic peptide
ERGYSYGSFD

SEQ ID NO: 2628 - protein, 7 aa, Artificial Sequence
  Description of Artificial Sequence: Synthetic peptide
SQGISSY

SEQ ID NO: 2629 - protein, 3 aa, Artificial Sequence
  Description of Artificial Sequence: Synthetic peptide
AAS

SEQ ID NO: 2630 - protein, 6 aa, Artificial Sequence
  Description of Artificial Sequence: Synthetic peptide
FNSYSL

SEQ ID NO: 2631 - protein, 10 aa, Artificial Sequence
  Description of Artificial Sequence: Synthetic peptide
GYTFTSEYIH

SEQ ID NO: 2632 - protein, 10 aa, Artificial Sequence
  Description of Artificial Sequence: Synthetic peptide
IINPSGGSTS

SEQ ID NO: 2633 - protein, 11 aa, Artificial Sequence
  Description of Artificial Sequence: Synthetic peptide
ERGYSYGSFDY

SEQ ID NO: 2634 - protein, 11 aa, Artificial Sequence
  Description of Artificial Sequence: Synthetic peptide
RASQGISSYLA

SEQ ID NO: 2635 - protein, 7 aa, Artificial Sequence
  Description of Artificial Sequence: Synthetic peptide
AASTLQS

SEQ ID NO: 2636 - protein, 9 aa, Artificial Sequence
  Description of Artificial Sequence: Synthetic peptide
QQFNSYSLT

SEQ ID NO: 2637 - protein, 6 aa, Artificial Sequence
  Description of Artificial Sequence: Synthetic peptide
TSEYIH

SEQ ID NO: 2638 - protein, 13 aa, Artificial Sequence
  Description of Artificial Sequence: Synthetic peptide
WMGIINPSGGSTS

SEQ ID NO: 2639 - protein, 12 aa, Artificial Sequence
  Description of Artificial Sequence: Synthetic peptide
ARERGYSYGSFD

SEQ ID NO: 2640 - protein, 7 aa, Artificial Sequence
  Description of Artificial Sequence: Synthetic peptide
SSYLAWY

SEQ ID NO: 2641 - protein, 10 aa, Artificial Sequence
  Description of Artificial Sequence: Synthetic peptide
LLIYAASTLQ

SEQ ID NO: 2642 - protein, 8 aa, Artificial Sequence
  Description of Artificial Sequence: Synthetic peptide
QQFNSYSL

SEQ ID NO: 2643 - protein, 8 aa, Artificial Sequence
  Description of Artificial Sequence: Synthetic peptide
GYTFTSEY

SEQ ID NO: 2644 - protein, 8 aa, Artificial Sequence
  Description of Artificial Sequence: Synthetic peptide
INPSGGST

SEQ ID NO: 2645 - protein, 13 aa, Artificial Sequence
  Description of Artificial Sequence: Synthetic peptide
ARERGYSYGSFDY

SEQ ID NO: 2646 - protein, 6 aa, Artificial Sequence
  Description of Artificial Sequence: Synthetic peptide
QGISSY

SEQ ID NO: 2647 - protein, 3 aa, Artificial Sequence
  Description of Artificial Sequence: Synthetic peptide
AAS

SEQ ID NO: 2648 - protein, 9 aa, Artificial Sequence
  Description of Artificial Sequence: Synthetic peptide
QQFNSYSLT

SEQ ID NO: 2649 - protein, 120 aa, Artificial Sequence
  Description of Artificial Sequence: Synthetic polypeptide
QVQLVESGAEVKKPGASVKVSCKASGYTFTSEYIHWVRQAPGQGLEWMGIINPSGGSTSYAQRFQGRVTMTRDTSTSTVYMEVNSLRSEDTAVYYCARERGYSYGSFDYWGQGTLVTVSS

SEQ ID NO: 2650 - protein, 107 aa, Artificial Sequence
  Description of Artificial Sequence: Synthetic polypeptide
EIVLTQSPSFLSASAGDRVTITCRASQGISSYLAWYQQKPEKAPKLLIYAASTLQSGVPSRFSGSGSGTEFTLTISSLQPEDFATYYCQQFNSYSLTFGGGTKLEIK

SEQ ID NO: 2651 - protein, 450 aa, Artificial Sequence
  Description of Artificial Sequence: Synthetic polypeptide
QVQLVESGAEVKKPGASVKVSCKASGYTFTSEYIHWVRQAPGQGLEWMGIINPSGGSTSYAQRFQGRVTMTRDTSTSTVYMEVNSLRSEDTAVYYCARERGYSYGSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2652 - protein, 214 aa, Artificial Sequence
  Description of Artificial Sequence: Synthetic polypeptide
EIVLTQSPSFLSASAGDRVTITCRASQGISSYLAWYQQKPEKAPKLLIYAASTLQSGVPSRFSGSGSGTEFTLTISSLQPEDFATYYCQQFNSYSLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2653 - protein, 5 aa, Artificial Sequence
  Description of Artificial Sequence: Synthetic peptide
GYYWS

SEQ ID NO: 2654 - protein, 16 aa, Artificial Sequence
  Description of Artificial Sequence: Synthetic peptide
YIFYSGSINYNPSLKN

SEQ ID NO: 2655 - protein, 12 aa, Artificial Sequence
  Description of Artificial Sequence: Synthetic peptide
VGKWELRSSFDI

SEQ ID NO: 2656 - protein, 13 aa, Artificial Sequence
  Description of Artificial Sequence: Synthetic peptide
SGSTSNIGNNDVS

SEQ ID NO: 2657 - protein, 7 aa, Artificial Sequence
  Description of Artificial Sequence: Synthetic peptide
DNNKRPS

SEQ ID NO: 2658 - protein, 11 aa, Artificial Sequence
  Description of Artificial Sequence: Synthetic peptide
GTWDSSLSVWV

SEQ ID NO: 2659 - protein, 7 aa, Artificial Sequence
  Description of Artificial Sequence: Synthetic peptide
GGSISGY

SEQ ID NO: 2660 - protein, 5 aa, Artificial Sequence
  Description of Artificial Sequence: Synthetic peptide
FYSGS

SEQ ID NO: 2661 - protein, 11 aa, Artificial Sequence
  Description of Artificial Sequence: Synthetic peptide
VGKWELRSSFD

SEQ ID NO: 2662 - protein, 9 aa, Artificial Sequence
  Description of Artificial Sequence: Synthetic peptide
STSNIGNND

SEQ ID NO: 2663 - protein, 3 aa, Artificial Sequence
  Description of Artificial Sequence: Synthetic peptide
DNN

SEQ ID NO: 2664 - protein, 8 aa, Artificial Sequence
  Description of Artificial Sequence: Synthetic peptide
WDSSLSVW

SEQ ID NO: 2665 - protein, 10 aa, Artificial Sequence
  Description of Artificial Sequence: Synthetic peptide
GGSISGYYWS

SEQ ID NO: 2666 - protein, 9 aa, Artificial Sequence
  Description of Artificial Sequence: Synthetic peptide
YIFYSGSIN

SEQ ID NO: 2667 - protein, 12 aa, Artificial Sequence
  Description of Artificial Sequence: Synthetic peptide
VGKWELRSSFDI

SEQ ID NO: 2668 - protein, 13 aa, Artificial Sequence
  Description of Artificial Sequence: Synthetic peptide
SGSTSNIGNNDVS

SEQ ID NO: 2669 - protein, 7 aa, Artificial Sequence
  Description of Artificial Sequence: Synthetic peptide
DNNKRPS

SEQ ID NO: 2670 - protein, 11 aa, Artificial Sequence
  Description of Artificial Sequence: Synthetic peptide
GTWDSSLSVWV

SEQ ID NO: 2671 - protein, 6 aa, Artificial Sequence
  Description of Artificial Sequence: Synthetic peptide
SGYYWS

SEQ ID NO: 2672 - protein, 12 aa, Artificial Sequence
  Description of Artificial Sequence: Synthetic peptide
LIGYIFYSGSIN

SEQ ID NO: 2673 - protein, 13 aa, Artificial Sequence
  Description of Artificial Sequence: Synthetic peptide
ARVGKWELRSSFD

SEQ ID NO: 2674 - protein, 9 aa, Artificial Sequence
  Description of Artificial Sequence: Synthetic peptide
IGNNDVSWY

SEQ ID NO: 2675 - protein, 10 aa, Artificial Sequence
  Description of Artificial Sequence: Synthetic peptide
LLIYDNNKRP

SEQ ID NO: 2676 - protein, 10 aa, Artificial Sequence
  Description of Artificial Sequence: Synthetic peptide
GTWDSSLSVW

SEQ ID NO: 2677 - protein, 8 aa, Artificial Sequence
  Description of Artificial Sequence: Synthetic peptide
GGSISGYY

SEQ ID NO: 2678 - protein, 7 aa, Artificial Sequence
  Description of Artificial Sequence: Synthetic peptide
IFYSGSI

SEQ ID NO: 2679 - protein, 14 aa, Artificial Sequence
  Description of Artificial Sequence: Synthetic peptide
ARVGKWELRSSFDI

SEQ ID NO: 2680 - protein, 8 aa, Artificial Sequence
  Description of Artificial Sequence: Synthetic peptide
TSNIGNND

SEQ ID NO: 2681 - protein, 3 aa, Artificial Sequence
  Description of Artificial Sequence: Synthetic peptide
DNN

SEQ ID NO: 2682 - protein, 11 aa, Artificial Sequence
  Description of Artificial Sequence: Synthetic peptide
GTWDSSLSVWV

SEQ ID NO: 2683 - protein, 120 aa, Artificial Sequence
  Description of Artificial Sequence: Synthetic polypeptide
QVQLQESGPGLVKPSETLSLTCTVSGGSISGYYWSWIRQPPGKGLELIGYIFYSGSINYNPSLKNRVTISLDTSKNQFSLKLTSVTAADTAVYYCARVGKWELRSSFDIWGQGTMVTVSS

SEQ ID NO: 2684 - protein, 110 aa, Artificial Sequence
  Description of Artificial Sequence: Synthetic polypeptide
QSVLTQPPSVSAAPGQKVTISCSGSTSNIGNNDVSWYQQLPGTAPKLLIYDNNKRPSGIPDRFSGSKSGTSATLGITGLQTGDEADYYCGTWDSSLSVWVFGGGTKLTVL

SEQ ID NO: 2685 - protein, 450 aa, Artificial Sequence
  Description of Artificial Sequence: Synthetic polypeptide
QVQLQESGPGLVKPSETLSLTCTVSGGSISGYYWSWIRQPPGKGLELIGYIFYSGSINYNPSLKNRVTISLDTSKNQFSLKLTSVTAADTAVYYCARVGKWELRSSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2686 - protein, 216 aa, Artificial Sequence
  Description of Artificial Sequence: Synthetic polypeptide
QSVLTQPPSVSAAPGQKVTISCSGSTSNIGNNDVSWYQQLPGTAPKLLIYDNNKRPSGIPDRFSGSKSGTSATLGITGLQTGDEADYYCGTWDSSLSVWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2687 - protein, 7 aa, Artificial Sequence
  Description of Artificial Sequence: Synthetic peptide
NGGFYWS

SEQ ID NO: 2688 - protein, 16 aa, Artificial Sequence
  Description of Artificial Sequence: Synthetic peptide
YINYSGSTYYNPSLES

SEQ ID NO: 2689 - protein, 10 aa, Artificial Sequence
  Description of Artificial Sequence: Synthetic peptide
DRNYEWNFDL

SEQ ID NO: 2690 - protein, 11 aa, Artificial Sequence
  Description of Artificial Sequence: Synthetic peptide
RASQSVSSYLA

SEQ ID NO: 2691 - protein, 7 aa, Artificial Sequence
  Description of Artificial Sequence: Synthetic peptide
DASNRAT

SEQ ID NO: 2692 - protein, 9 aa, Artificial Sequence
  Description of Artificial Sequence: Synthetic peptide
QQRSNWPLT

SEQ ID NO: 2693 - protein, 9 aa, Artificial Sequence
  Description of Artificial Sequence: Synthetic peptide
GGSISNGGF

SEQ ID NO: 2694 - protein, 5 aa, Artificial Sequence
  Description of Artificial Sequence: Synthetic peptide
NYSGS

SEQ ID NO: 2695 - protein, 9 aa, Artificial Sequence
  Description of Artificial Sequence: Synthetic peptide
DRNYEWNFD

SEQ ID NO: 2696 - protein, 7 aa, Artificial Sequence
  Description of Artificial Sequence: Synthetic peptide
SQSVSSY

SEQ ID NO: 2697 - protein, 3 aa, Artificial Sequence
  Description of Artificial Sequence: Synthetic peptide
DAS

SEQ ID NO: 2698 - protein, 6 aa, Artificial Sequence
  Description of Artificial Sequence: Synthetic peptide
RSNWPL

SEQ ID NO: 2699 - protein, 12 aa, Artificial Sequence
  Description of Artificial Sequence: Synthetic peptide
GGSISNGGFYWS

SEQ ID NO: 2700 - protein, 9 aa, Artificial Sequence
  Description of Artificial Sequence: Synthetic peptide
YINYSGSTY

SEQ ID NO: 2701 - protein, 10 aa, Artificial Sequence
  Description of Artificial Sequence: Synthetic peptide
DRNYEWNFDL

SEQ ID NO: 2702 - protein, 11 aa, Artificial Sequence
  Description of Artificial Sequence: Synthetic peptide
RASQSVSSYLA

SEQ ID NO: 2703 - protein, 7 aa, Artificial Sequence
  Description of Artificial Sequence: Synthetic peptide
DASNRAT

SEQ ID NO: 2704 - protein, 9 aa, Artificial Sequence
  Description of Artificial Sequence: Synthetic peptide
QQRSNWPLT

SEQ ID NO: 2705 - protein, 8 aa, Artificial Sequence
  Description of Artificial Sequence: Synthetic peptide
SNGGFYWS

SEQ ID NO: 2706 - protein, 12 aa, Artificial Sequence
  Description of Artificial Sequence: Synthetic peptide
WLGYINYSGSTY

SEQ ID NO: 2707 - protein, 11 aa, Artificial Sequence
  Description of Artificial Sequence: Synthetic peptide
ARDRNYEWNFD

SEQ ID NO: 2708 - protein, 7 aa, Artificial Sequence
  Description of Artificial Sequence: Synthetic peptide
SSYLAWY

SEQ ID NO: 2709 - protein, 10 aa, Artificial Sequence
  Description of Artificial Sequence: Synthetic peptide
LLVYDASNRA

SEQ ID NO: 2710 - protein, 8 aa, Artificial Sequence
  Description of Artificial Sequence: Synthetic peptide
QQRSNWPL

SEQ ID NO: 2711 - protein, 10 aa, Artificial Sequence
  Description of Artificial Sequence: Synthetic peptide
GGSISNGGFY

SEQ ID NO: 2712 - protein, 7 aa, Artificial Sequence
  Description of Artificial Sequence: Synthetic peptide
INYSGST

SEQ ID NO: 2713 - protein, 12 aa, Artificial Sequence
  Description of Artificial Sequence: Synthetic peptide
ARDRNYEWNFDL

SEQ ID NO: 2714 - protein, 6 aa, Artificial Sequence
  Description of Artificial Sequence: Synthetic peptide
QSVSSY

SEQ ID NO: 2715 - protein, 3 aa, Artificial Sequence
  Description of Artificial Sequence: Synthetic peptide
DAS

SEQ ID NO: 2716 - protein, 9 aa, Artificial Sequence
  Description of Artificial Sequence: Synthetic peptide
QQRSNWPLT

SEQ ID NO: 2717 - protein, 120 aa, Artificial Sequence
  Description of Artificial Sequence: Synthetic polypeptide
QVQLQESGPGLVKPSQTLSLTCTVSGGSISNGGFYWSWIRQHPGKGLEWLGYINYSGSTYYNPSLESRGTISLDTSKNQFSLKLRSVTAADTAVYYCARDRNYEWNFDLWGRGTLVTVSS

SEQ ID NO: 2718 - protein, 107 aa, Artificial Sequence
  Description of Artificial Sequence: Synthetic polypeptide
EIVMTQSPATLSLSPGEGATLSCRASQSVSSYLAWYQQKPGQAPRLLVYDASNRATGIPARFSGSGSGTAFTLTITSLEPEDFVVYYCQQRSNWPLTFGGGTKLEIK

SEQ ID NO: 2719 - protein, 450 aa, Artificial Sequence
  Description of Artificial Sequence: Synthetic polypeptide
QVQLQESGPGLVKPSQTLSLTCTVSGGSISNGGFYWSWIRQHPGKGLEWLGYINYSGSTYYNPSLESRGTISLDTSKNQFSLKLRSVTAADTAVYYCARDRNYEWNFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2720 - protein, 214 aa, Artificial Sequence
  Description of Artificial Sequence: Synthetic polypeptide
EIVMTQSPATLSLSPGEGATLSCRASQSVSSYLAWYQQKPGQAPRLLVYDASNRATGIPARFSGSGSGTAFTLTITSLEPEDFVVYYCQQRSNWPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2721 - protein, 7 aa, Artificial Sequence
  Description of Artificial Sequence: Synthetic peptide
NIRMSVS

SEQ ID NO: 2722 - protein, 16 aa, Artificial Sequence
  Description of Artificial Sequence: Synthetic peptide
HIFSNDEKSYNSSLKS

SEQ ID NO: 2723 - protein, 9 aa, Artificial Sequence
  Description of Artificial Sequence: Synthetic peptide
MRLPYGMDV

SEQ ID NO: 2724 - protein, 13 aa, Artificial Sequence
  Description of Artificial Sequence: Synthetic peptide
SGSTSNIGSNTVN

SEQ ID NO: 2725 - protein, 7 aa, Artificial Sequence
  Description of Artificial Sequence: Synthetic peptide
SNNQRPS

SEQ ID NO: 2726 - protein, 11 aa, Artificial Sequence
  Description of Artificial Sequence: Synthetic peptide
AAWDDSLNGPV

SEQ ID NO: 2727 - protein, 9 aa, Artificial Sequence
  Description of Artificial Sequence: Synthetic peptide
GFSLTNIRM

SEQ ID NO: 2728 - protein, 5 aa, Artificial Sequence
  Description of Artificial Sequence: Synthetic peptide
FSNDE

SEQ ID NO: 2729 - protein, 8 aa, Artificial Sequence
  Description of Artificial Sequence: Synthetic peptide
MRLPYGMD

SEQ ID NO: 2730 - protein, 9 aa, Artificial Sequence
  Description of Artificial Sequence: Synthetic peptide
STSNIGSNT

SEQ ID NO: 2731 - protein, 3 aa, Artificial Sequence
  Description of Artificial Sequence: Synthetic peptide
SNN

SEQ ID NO: 2732 - protein, 8 aa, Artificial Sequence
  Description of Artificial Sequence: Synthetic peptide
WDDSLNGP

SEQ ID NO: 2733 - protein, 12 aa, Artificial Sequence
  Description of Artificial Sequence: Synthetic peptide
GFSLTNIRMSVS

SEQ ID NO: 2734 - protein, 9 aa, Artificial Sequence
  Description of Artificial Sequence: Synthetic peptide
HIFSNDEKS

SEQ ID NO: 2735 - protein, 9 aa, Artificial Sequence
  Description of Artificial Sequence: Synthetic peptide
MRLPYGMDV

SEQ ID NO: 2736 - protein, 13 aa, Artificial Sequence
  Description of Artificial Sequence: Synthetic peptide
SGSTSNIGSNTVN

SEQ ID NO: 2737 - protein, 7 aa, Artificial Sequence
  Description of Artificial Sequence: Synthetic peptide
SNNQRPS

SEQ ID NO: 2738 - protein, 11 aa, Artificial Sequence
  Description of Artificial Sequence: Synthetic peptide
AAWDDSLNGPV

SEQ ID NO: 2739 - protein, 8 aa, Artificial Sequence
  Description of Artificial Sequence: Synthetic peptide
TNIRMSVS

SEQ ID NO: 2740 - protein, 12 aa, Artificial Sequence
  Description of Artificial Sequence: Synthetic peptide
WLAHIFSNDEKS

SEQ ID NO: 2741 - protein, 10 aa, Artificial Sequence
  Description of Artificial Sequence: Synthetic peptide
ARMRLPYGMD

SEQ ID NO: 2742 - protein, 9 aa, Artificial Sequence
  Description of Artificial Sequence: Synthetic peptide
IGSNTVNWY

SEQ ID NO: 2743 - protein, 10 aa, Artificial Sequence
  Description of Artificial Sequence: Synthetic peptide
LLIYSNNQRP

SEQ ID NO: 2744 - protein, 10 aa, Artificial Sequence
  Description of Artificial Sequence: Synthetic peptide
AAWDDSLNGP

SEQ ID NO: 2745 - protein, 10 aa, Artificial Sequence
  Description of Artificial Sequence: Synthetic peptide
GFSLTNIRMS

SEQ ID NO: 2746 - protein, 7 aa, Artificial Sequence
  Description of Artificial Sequence: Synthetic peptide
IFSNDEK

SEQ ID NO: 2747 - protein, 11 aa, Artificial Sequence
  Description of Artificial Sequence: Synthetic peptide
ARMRLPYGMDV

SEQ ID NO: 2748 - protein, 8 aa, Artificial Sequence
  Description of Artificial Sequence: Synthetic peptide
TSNIGSNT

SEQ ID NO: 2749 - protein, 3 aa, Artificial Sequence
  Description of Artificial Sequence: Synthetic peptide
SNN

SEQ ID NO: 2750 - protein, 11 aa, Artificial Sequence
  Description of Artificial Sequence: Synthetic peptide
AAWDDSLNGPV

SEQ ID NO: 2751 - protein, 119 aa, Artificial Sequence
  Description of Artificial Sequence: Synthetic polypeptide
QVTLRESGPVLVKPTETLTLTCTVSGFSLTNIRMSVSWIRQPPGEALEWLAHIFSNDEKSYNSSLKSRLTISRDTSKSQVVLTLTNVDPVDTATYYCARMRLPYGMDVWGQGTMVTVSS

SEQ ID NO: 2752 - protein, 110 aa, Artificial Sequence
  Description of Artificial Sequence: Synthetic polypeptide
QSVLTQPPSASGTPGQRVTISCSGSTSNIGSNTVNWYQQLPGTAPKLLIYSNNQRPSGVPDRFSGSKSGTSASLAISGLQSEDEADFYCAAWDDSLNGPVFGGGTKVTVL

SEQ ID NO: 2753 - protein, 449 aa, Artificial Sequence
  Description of Artificial Sequence: Synthetic polypeptide
QVTLRESGPVLVKPTETLTLTCTVSGFSLTNIRMSVSWIRQPPGEALEWLAHIFSNDEKSYNSSLKSRLTISRDTSKSQVVLTLTNVDPVDTATYYCARMRLPYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2754 - protein, 216 aa, Artificial Sequence
  Description of Artificial Sequence: Synthetic polypeptide
QSVLTQPPSASGTPGQRVTISCSGSTSNIGSNTVNWYQQLPGTAPKLLIYSNNQRPSGVPDRFSGSKSGTSASLAISGLQSEDEADFYCAAWDDSLNGPVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2755 - protein, 5 aa, Artificial Sequence
  Description of Artificial Sequence: Synthetic peptide
NYFWS

SEQ ID NO: 2756 - protein, 16 aa, Artificial Sequence
  Description of Artificial Sequence: Synthetic peptide
YIFYSGSTNYNPSLKS

SEQ ID NO: 2757 - protein, 12 aa, Artificial Sequence
  Description of Artificial Sequence: Synthetic peptide
VGKWELRTAFDI

SEQ ID NO: 2758 - protein, 14 aa, Artificial Sequence
  Description of Artificial Sequence: Synthetic peptide
TGTSSDVADYNYVS

SEQ ID NO: 2759 - protein, 7 aa, Artificial Sequence
  Description of Artificial Sequence: Synthetic peptide
EVSNRPS

SEQ ID NO: 2760 - protein, 10 aa, Artificial Sequence
  Description of Artificial Sequence: Synthetic peptide
CSYTSSFTVV

SEQ ID NO: 2761 - protein, 7 aa, Artificial Sequence
  Description of Artificial Sequence: Synthetic peptide
GGSINNY

SEQ ID NO: 2762 - protein, 5 aa, Artificial Sequence
  Description of Artificial Sequence: Synthetic peptide
FYSGS

SEQ ID NO: 2763 - protein, 11 aa, Artificial Sequence
  Description of Artificial Sequence: Synthetic peptide
VGKWELRTAFD

SEQ ID NO: 2764 - protein, 10 aa, Artificial Sequence
  Description of Artificial Sequence: Synthetic peptide
TSSDVADYNY

SEQ ID NO: 2765 - protein, 3 aa, Artificial Sequence
  Description of Artificial Sequence: Synthetic peptide
EVS

SEQ ID NO: 2766 - protein, 7 aa, Artificial Sequence
  Description of Artificial Sequence: Synthetic peptide
YTSSFTV

SEQ ID NO: 2767 - protein, 10 aa, Artificial Sequence
  Description of Artificial Sequence: Synthetic peptide
GGSINNYFWS

SEQ ID NO: 2768 - protein, 9 aa, Artificial Sequence
  Description of Artificial Sequence: Synthetic peptide
YIFYSGSTN

SEQ ID NO: 2769 - protein, 12 aa, Artificial Sequence
  Description of Artificial Sequence: Synthetic peptide
VGKWELRTAFDI

SEQ ID NO: 2770 - protein, 14 aa, Artificial Sequence
  Description of Artificial Sequence: Synthetic peptide
TGTSSDVADYNYVS

SEQ ID NO: 2771 - protein, 7 aa, Artificial Sequence
  Description of Artificial Sequence: Synthetic peptide
EVSNRPS

SEQ ID NO: 2772 - protein, 10 aa, Artificial Sequence
  Description of Artificial Sequence: Synthetic peptide
CSYTSSFTVV

SEQ ID NO: 2773 - protein, 6 aa, Artificial Sequence
  Description of Artificial Sequence: Synthetic peptide
NNYFWS

SEQ ID NO: 2774 - protein, 12 aa, Artificial Sequence
  Description of Artificial Sequence: Synthetic peptide
WIGYIFYSGSTN

SEQ ID NO: 2775 - protein, 13 aa, Artificial Sequence
  Description of Artificial Sequence: Synthetic peptide
ARVGKWELRTAFD

SEQ ID NO: 2776 - protein, 10 aa, Artificial Sequence
  Description of Artificial Sequence: Synthetic peptide
VADYNYVSWY

SEQ ID NO: 2777 - protein, 10 aa, Artificial Sequence
  Description of Artificial Sequence: Synthetic peptide
LMIYEVSNRP

SEQ ID NO: 2778 - protein, 9 aa, Artificial Sequence
  Description of Artificial Sequence: Synthetic peptide
CSYTSSFTV

SEQ ID NO: 2779 - protein, 8 aa, Artificial Sequence
  Description of Artificial Sequence: Synthetic peptide
GGSINNYF

SEQ ID NO: 2780 - protein, 7 aa, Artificial Sequence
  Description of Artificial Sequence: Synthetic peptide
IFYSGST

SEQ ID NO: 2781 - protein, 14 aa, Artificial Sequence
  Description of Artificial Sequence: Synthetic peptide
ARVGKWELRTAFDI

SEQ ID NO: 2782 - protein, 9 aa, Artificial Sequence
  Description of Artificial Sequence: Synthetic peptide
SSDVADYNY

SEQ ID NO: 2783 - protein, 3 aa, Artificial Sequence
  Description of Artificial Sequence: Synthetic peptide
EVS

SEQ ID NO: 2784 - protein, 10 aa, Artificial Sequence
  Description of Artificial Sequence: Synthetic peptide
CSYTSSFTVV

SEQ ID NO: 2785 - protein, 120 aa, Artificial Sequence
  Description of Artificial Sequence: Synthetic polypeptide
QVQLQESGPGLVKPSETLSLTCTVSGGSINNYFWSWIRQPPGKGLEWIGYIFYSGSTNYNPSLKSRVTISIDTSKNQFSLKVNSVTAADTAVYYCARVGKWELRTAFDIWGQGTMVTVSS

SEQ ID NO: 2786 - protein, 110 aa, Artificial Sequence
  Description of Artificial Sequence: Synthetic polypeptide
QSALTQPASVSGSPGQSITISCTGTSSDVADYNYVSWYQQHPGKAPKLMIYEVSNRPSGVSNRFSGSKSGNTASLTISGLQAEDEADYYCCSYTSSFTVVFGGGTKVTVL

SEQ ID NO: 2787 - protein, 450 aa, Artificial Sequence
  Description of Artificial Sequence: Synthetic polypeptide
QVQLQESGPGLVKPSETLSLTCTVSGGSINNYFWSWIRQPPGKGLEWIGYIFYSGSTNYNPSLKSRVTISIDTSKNQFSLKVNSVTAADTAVYYCARVGKWELRTAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2788 - protein, 216 aa, Artificial Sequence
  Description of Artificial Sequence: Synthetic polypeptide
QSALTQPASVSGSPGQSITISCTGTSSDVADYNYVSWYQQHPGKAPKLMIYEVSNRPSGVSNRFSGSKSGNTASLTISGLQAEDEADYYCCSYTSSFTVVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2789 - protein, 5 aa, Artificial Sequence
  Description of Artificial Sequence: Synthetic peptide
RYDMH

SEQ ID NO: 2790 - protein, 16 aa, Artificial Sequence
  Description of Artificial Sequence: Synthetic peptide
AIGSAGDTYYPGSVKG

SEQ ID NO: 2791 - protein, 11 aa, Artificial Sequence
  Description of Artificial Sequence: Synthetic peptide
GKWELRDAFDI

SEQ ID NO: 2792 - protein, 11 aa, Artificial Sequence
  Description of Artificial Sequence: Synthetic peptide
RASQGIHSYLA

SEQ ID NO: 2793 - protein, 7 aa, Artificial Sequence
  Description of Artificial Sequence: Synthetic peptide
VASTLQS

SEQ ID NO: 2794 - protein, 9 aa, Artificial Sequence
  Description of Artificial Sequence: Synthetic peptide
QQLNSYPYT

SEQ ID NO: 2795 - protein, 7 aa, Artificial Sequence
  Description of Artificial Sequence: Synthetic peptide
GFTFSRY

SEQ ID NO: 2796 - protein, 5 aa, Artificial Sequence
  Description of Artificial Sequence: Synthetic peptide
GSAGD

SEQ ID NO: 2797 - protein, 10 aa, Artificial Sequence
  Description of Artificial Sequence: Synthetic peptide
GKWELRDAFD

SEQ ID NO: 2798 - protein, 7 aa, Artificial Sequence
  Description of Artificial Sequence: Synthetic peptide
SQGIHSY

SEQ ID NO: 2799 - protein, 3 aa, Artificial Sequence
  Description of Artificial Sequence: Synthetic peptide
VAS

SEQ ID NO: 2800 - protein, 6 aa, Artificial Sequence
  Description of Artificial Sequence: Synthetic peptide
LNSYPY

SEQ ID NO: 2801 - protein, 10 aa, Artificial Sequence
  Description of Artificial Sequence: Synthetic peptide
GFTFSRYDMH

SEQ ID NO: 2802 - protein, 9 aa, Artificial Sequence
  Description of Artificial Sequence: Synthetic peptide
AIGSAGDTY

SEQ ID NO: 2803 - protein, 11 aa, Artificial Sequence
  Description of Artificial Sequence: Synthetic peptide
GKWELRDAFDI

SEQ ID NO: 2804 - protein, 11 aa, Artificial Sequence
  Description of Artificial Sequence: Synthetic peptide
RASQGIHSYLA

SEQ ID NO: 2805 - protein, 7 aa, Artificial Sequence
  Description of Artificial Sequence: Synthetic peptide
VASTLQS

SEQ ID NO: 2806 - protein, 9 aa, Artificial Sequence
  Description of Artificial Sequence: Synthetic peptide
QQLNSYPYT

SEQ ID NO: 2807 - protein, 6 aa, Artificial Sequence
  Description of Artificial Sequence: Synthetic peptide
SRYDMH

SEQ ID NO: 2808 - protein, 12 aa, Artificial Sequence
  Description of Artificial Sequence: Synthetic peptide
WVSAIGSAGDTY

SEQ ID NO: 2809 - protein, 12 aa, Artificial Sequence
  Description of Artificial Sequence: Synthetic peptide
ARGKWELRDAFD

SEQ ID NO: 2810 - protein, 7 aa, Artificial Sequence
  Description of Artificial Sequence: Synthetic peptide
HSYLAWY

SEQ ID NO: 2811 - protein, 10 aa, Artificial Sequence
  Description of Artificial Sequence: Synthetic peptide
LLIYVASTLQ

SEQ ID NO: 2812 - protein, 8 aa, Artificial Sequence
  Description of Artificial Sequence: Synthetic peptide
QQLNSYPY

SEQ ID NO: 2813 - protein, 8 aa, Artificial Sequence
  Description of Artificial Sequence: Synthetic peptide
GFTFSRYD

SEQ ID NO: 2814 - protein, 7 aa, Artificial Sequence
  Description of Artificial Sequence: Synthetic peptide
IGSAGDT

SEQ ID NO: 2815 - protein, 13 aa, Artificial Sequence
  Description of Artificial Sequence: Synthetic peptide
ARGKWELRDAFDI

SEQ ID NO: 2816 - protein, 6 aa, Artificial Sequence
  Description of Artificial Sequence: Synthetic peptide
QGIHSY

SEQ ID NO: 2817 - protein, 3 aa, Artificial Sequence
  Description of Artificial Sequence: Synthetic peptide
VAS

SEQ ID NO: 2818 - protein, 9 aa, Artificial Sequence
  Description of Artificial Sequence: Synthetic peptide
QQLNSYPYT

SEQ ID NO: 2819 - protein, 119 aa, Artificial Sequence
  Description of Artificial Sequence: Synthetic polypeptide
EVQLVESGGDLVQPGGSLRLSCAASGFTFSRYDMHWVRQATGKGLEWVSAIGSAGDTYYPGSVKGRFTISRENAKNSLYLQMNSLRAGDTAVYYCARGKWELRDAFDIWGQGTMVTVSS

SEQ ID NO: 2820 - protein, 107 aa, Artificial Sequence
  Description of Artificial Sequence: Synthetic polypeptide
DIVMTQSPSFLSASVGDRVTITCRASQGIHSYLAWYQQKPGKAPKLLIYVASTLQSGVPSRFSGSRSGTEFTLTISSLQPEDFATYYCQQLNSYPYTFGQGTKLEIK

SEQ ID NO: 2821 - protein, 449 aa, Artificial Sequence
  Description of Artificial Sequence: Synthetic polypeptide
EVQLVESGGDLVQPGGSLRLSCAASGFTFSRYDMHWVRQATGKGLEWVSAIGSAGDTYYPGSVKGRFTISRENAKNSLYLQMNSLRAGDTAVYYCARGKWELRDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2822 - protein, 214 aa, Artificial Sequence
  Description of Artificial Sequence: Synthetic polypeptide
DIVMTQSPSFLSASVGDRVTITCRASQGIHSYLAWYQQKPGKAPKLLIYVASTLQSGVPSRFSGSRSGTEFTLTISSLQPEDFATYYCQQLNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2823 - protein, 5 aa, Artificial Sequence
  Description of Artificial Sequence: Synthetic peptide
GYFWN

SEQ ID NO: 2824 - protein, 16 aa, Artificial Sequence
  Description of Artificial Sequence: Synthetic peptide
YIFYSGSTNYNPSLKS

SEQ ID NO: 2825 - protein, 12 aa, Artificial Sequence
  Description of Artificial Sequence: Synthetic peptide
EGKWELRSTFDI

SEQ ID NO: 2826 - protein, 11 aa, Artificial Sequence
  Description of Artificial Sequence: Synthetic peptide
QGDSLRSYYAT

SEQ ID NO: 2827 - protein, 7 aa, Artificial Sequence
  Description of Artificial Sequence: Synthetic peptide
GENNRPS

SEQ ID NO: 2828 - protein, 11 aa, Artificial Sequence
  Description of Artificial Sequence: Synthetic peptide
NSRDTGDHHLV

SEQ ID NO: 2829 - protein, 7 aa, Artificial Sequence
  Description of Artificial Sequence: Synthetic peptide
GGSISGY

SEQ ID NO: 2830 - protein, 5 aa, Artificial Sequence
  Description of Artificial Sequence: Synthetic peptide
FYSGS

SEQ ID NO: 2831 - protein, 11 aa, Artificial Sequence
  Description of Artificial Sequence: Synthetic peptide
EGKWELRSTFD

SEQ ID NO: 2832 - protein, 7 aa, Artificial Sequence
  Description of Artificial Sequence: Synthetic peptide
DSLRSYY

SEQ ID NO: 2833 - protein, 3 aa, Artificial Sequence
  Description of Artificial Sequence: Synthetic peptide
GEN

SEQ ID NO: 2834 - protein, 8 aa, Artificial Sequence
  Description of Artificial Sequence: Synthetic peptide
RDTGDHHL

SEQ ID NO: 2835 - protein, 10 aa, Artificial Sequence
  Description of Artificial Sequence: Synthetic peptide
GGSISGYFWN

SEQ ID NO: 2836 - protein, 9 aa, Artificial Sequence
  Description of Artificial Sequence: Synthetic peptide
YIFYSGSTN

SEQ ID NO: 2837 - protein, 12 aa, Artificial Sequence
  Description of Artificial Sequence: Synthetic peptide
EGKWELRSTFDI

SEQ ID NO: 2838 - protein, 11 aa, Artificial Sequence
  Description of Artificial Sequence: Synthetic peptide
QGDSLRSYYAT

SEQ ID NO: 2839 - protein, 7 aa, Artificial Sequence
  Description of Artificial Sequence: Synthetic peptide
GENNRPS

SEQ ID NO: 2840 - protein, 11 aa, Artificial Sequence
  Description of Artificial Sequence: Synthetic peptide
NSRDTGDHHLV

SEQ ID NO: 2841 - protein, 6 aa, Artificial Sequence
  Description of Artificial Sequence: Synthetic peptide
SGYFWN

SEQ ID NO: 2842 - protein, 12 aa, Artificial Sequence
  Description of Artificial Sequence: Synthetic peptide
WIGYIFYSGSTN

SEQ ID NO: 2843 - protein, 13 aa, Artificial Sequence
  Description of Artificial Sequence: Synthetic peptide
AREGKWELRSTFD

SEQ ID NO: 2844 - protein, 7 aa, Artificial Sequence
  Description of Artificial Sequence: Synthetic peptide
SYYATWY

SEQ ID NO: 2845 - protein, 10 aa, Artificial Sequence
  Description of Artificial Sequence: Synthetic peptide
LVIYGENNRP

SEQ ID NO: 2846 - protein, 10 aa, Artificial Sequence
  Description of Artificial Sequence: Synthetic peptide
NSRDTGDHHL

SEQ ID NO: 2847 - protein, 8 aa, Artificial Sequence
  Description of Artificial Sequence: Synthetic peptide
GGSISGYF

SEQ ID NO: 2848 - protein, 7 aa, Artificial Sequence
  Description of Artificial Sequence: Synthetic peptide
IFYSGST

SEQ ID NO: 2849 - protein, 14 aa, Artificial Sequence
  Description of Artificial Sequence: Synthetic peptide
AREGKWELRSTFDI

SEQ ID NO: 2850 - protein, 6 aa, Artificial Sequence
  Description of Artificial Sequence: Synthetic peptide
SLRSYY

SEQ ID NO: 2851 - protein, 3 aa, Artificial Sequence
  Description of Artificial Sequence: Synthetic peptide
GEN

SEQ ID NO: 2852 - protein, 11 aa, Artificial Sequence
  Description of Artificial Sequence: Synthetic peptide
NSRDTGDHHLV

SEQ ID NO: 2853 - protein, 120 aa, Artificial Sequence
  Description of Artificial Sequence: Synthetic polypeptide
QVQLQESGPGLVNPSETLSLTCTVSGGSISGYFWNWIRQPPGKGLEWIGYIFYSGSTNYNPSLKSRVTISVDTSKNQFSLKLSSVTAADTAIYYCAREGKWELRSTFDIWGQGTMVTVSS

SEQ ID NO: 2854 - protein, 108 aa, Artificial Sequence
  Description of Artificial Sequence: Synthetic polypeptide
SSELTQDPAVSVALGQTVRITCQGDSLRSYYATWYQQKPGQAPILVIYGENNRPSGIPDRFSGSRSGNTASLTITGAQAEDEADYYCNSRDTGDHHLVFGGGTKLTVL

SEQ ID NO: 2855 - protein, 450 aa, Artificial Sequence
  Description of Artificial Sequence: Synthetic polypeptide
QVQLQESGPGLVNPSETLSLTCTVSGGSISGYFWNWIRQPPGKGLEWIGYIFYSGSTNYNPSLKSRVTISVDTSKNQFSLKLSSVTAADTAIYYCAREGKWELRSTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2856 - protein, 214 aa, Artificial Sequence
  Description of Artificial Sequence: Synthetic polypeptide
SSELTQDPAVSVALGQTVRITCQGDSLRSYYATWYQQKPGQAPILVIYGENNRPSGIPDRFSGSRSGNTASLTITGAQAEDEADYYCNSRDTGDHHLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2857 - protein, 5 aa, Artificial Sequence
  Description of Artificial Sequence: Synthetic peptide
IYAIN

SEQ ID NO: 2858 - protein, 17 aa, Artificial Sequence
  Description of Artificial Sequence: Synthetic peptide
GIIPFFGTANYAQKFQD

SEQ ID NO: 2859 - protein, 12 aa, Artificial Sequence
  Description of Artificial Sequence: Synthetic peptide
GGDSGYDWGFDY

SEQ ID NO: 2860 - protein, 16 aa, Artificial Sequence
  Description of Artificial Sequence: Synthetic peptide
RSSQSLVHSDGNTYLS

SEQ ID NO: 2861 - protein, 7 aa, Artificial Sequence
  Description of Artificial Sequence: Synthetic peptide
QISNRFS

SEQ ID NO: 2862 - protein, 9 aa, Artificial Sequence
  Description of Artificial Sequence: Synthetic peptide
MQATQFPLT

SEQ ID NO: 2863 - protein, 7 aa, Artificial Sequence
  Description of Artificial Sequence: Synthetic peptide
GGTFNIY

SEQ ID NO: 2864 - protein, 6 aa, Artificial Sequence
  Description of Artificial Sequence: Synthetic peptide
IPFFGT

SEQ ID NO: 2865 - protein, 11 aa, Artificial Sequence
  Description of Artificial Sequence: Synthetic peptide
GGDSGYDWGFD

SEQ ID NO: 2866 - protein, 12 aa, Artificial Sequence
  Description of Artificial Sequence: Synthetic peptide
SQSLVHSDGNTY

SEQ ID NO: 2867 - protein, 3 aa, Artificial Sequence
  Description of Artificial Sequence: Synthetic peptide
QIS

SEQ ID NO: 2868 - protein, 6 aa, Artificial Sequence
  Description of Artificial Sequence: Synthetic peptide
ATQFPL

SEQ ID NO: 2869 - protein, 10 aa, Artificial Sequence
  Description of Artificial Sequence: Synthetic peptide
GGTFNIYAIN

SEQ ID NO: 2870 - protein, 10 aa, Artificial Sequence
  Description of Artificial Sequence: Synthetic peptide
GIIPFFGTAN

SEQ ID NO: 2871 - protein, 12 aa, Artificial Sequence
  Description of Artificial Sequence: Synthetic peptide
GGDSGYDWGFDY

SEQ ID NO: 2872 - protein, 16 aa, Artificial Sequence
  Description of Artificial Sequence: Synthetic peptide
RSSQSLVHSDGNTYLS

SEQ ID NO: 2873 - protein, 7 aa, Artificial Sequence
  Description of Artificial Sequence: Synthetic peptide
QISNRFS

SEQ ID NO: 2874 - protein, 9 aa, Artificial Sequence
  Description of Artificial Sequence: Synthetic peptide
MQATQFPLT

SEQ ID NO: 2875 - protein, 6 aa, Artificial Sequence
  Description of Artificial Sequence: Synthetic peptide
NIYAIN

SEQ ID NO: 2876 - protein, 13 aa, Artificial Sequence
  Description of Artificial Sequence: Synthetic peptide
WMGGIIPFFGTAN

SEQ ID NO: 2877 - protein, 13 aa, Artificial Sequence
  Description of Artificial Sequence: Synthetic peptide
ARGGDSGYDWGFD

SEQ ID NO: 2878 - protein, 12 aa, Artificial Sequence
  Description of Artificial Sequence: Synthetic peptide
VHSDGNTYLSWL

SEQ ID NO: 2879 - protein, 10 aa, Artificial Sequence
  Description of Artificial Sequence: Synthetic peptide
LLIYQISNRF

SEQ ID NO: 2880 - protein, 8 aa, Artificial Sequence
  Description of Artificial Sequence: Synthetic peptide
MQATQFPL

SEQ ID NO: 2881 - protein, 8 aa, Artificial Sequence
  Description of Artificial Sequence: Synthetic peptide
GGTFNIYA

SEQ ID NO: 2882 - protein, 8 aa, Artificial Sequence
  Description of Artificial Sequence: Synthetic peptide
IIPFFGTA

SEQ ID NO: 2883 - protein, 14 aa, Artificial Sequence
  Description of Artificial Sequence: Synthetic peptide
ARGGDSGYDWGFDY

SEQ ID NO: 2884 - protein, 11 aa, Artificial Sequence
  Description of Artificial Sequence: Synthetic peptide
QSLVHSDGNTY

SEQ ID NO: 2885 - protein, 3 aa, Artificial Sequence
  Description of Artificial Sequence: Synthetic peptide
QIS

SEQ ID NO: 2886 - protein, 9 aa, Artificial Sequence
  Description of Artificial Sequence: Synthetic peptide
MQATQFPLT

SEQ ID NO: 2887 - protein, 121 aa, Artificial Sequence
  Description of Artificial Sequence: Synthetic polypeptide
QVQLVQSGAEVKKPGSSVKVSCKASGGTFNIYAINWVRQAPGQGLEWMGGIIPFFGTANYAQKFQDRVTITADKSTNTAYMELSSLRSEDTAVFYCARGGDSGYDWGFDYWGQGTLVTVSS

SEQ ID NO: 2888 - protein, 112 aa, Artificial Sequence
  Description of Artificial Sequence: Synthetic polypeptide
DIVMTQTPLSSPVTLGQPASISCRSSQSLVHSDGNTYLSWLQQRPGQPPRLLIYQISNRFSGVPDRFSGSGAGTDFTLNISRVEADDVGVYYCMQATQFPLTFGGGTKVEIK

SEQ ID NO: 2889 - protein, 451 aa, Artificial Sequence
  Description of Artificial Sequence: Synthetic polypeptide
QVQLVQSGAEVKKPGSSVKVSCKASGGTFNIYAINWVRQAPGQGLEWMGGIIPFFGTANYAQKFQDRVTITADKSTNTAYMELSSLRSEDTAVFYCARGGDSGYDWGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2890 - protein, 219 aa, Artificial Sequence
  Description of Artificial Sequence: Synthetic polypeptide
DIVMTQTPLSSPVTLGQPASISCRSSQSLVHSDGNTYLSWLQQRPGQPPRLLIYQISNRFSGVPDRFSGSGAGTDFTLNISRVEADDVGVYYCMQATQFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2891 - protein, 5 aa, Artificial Sequence
  Description of Artificial Sequence: Synthetic peptide
TYYWS

SEQ ID NO: 2892 - protein, 16 aa, Artificial Sequence
  Description of Artificial Sequence: Synthetic peptide
RIYTSDNTNYNPSLKS

SEQ ID NO: 2893 - protein, 10 aa, Artificial Sequence
  Description of Artificial Sequence: Synthetic peptide
YNWNYWYFDL

SEQ ID NO: 2894 - protein, 11 aa, Artificial Sequence
  Description of Artificial Sequence: Synthetic peptide
RASQGISSYLA

SEQ ID NO: 2895 - protein, 7 aa, Artificial Sequence
  Description of Artificial Sequence: Synthetic peptide
TASTLQS

SEQ ID NO: 2896 - protein, 9 aa, Artificial Sequence
  Description of Artificial Sequence: Synthetic peptide
QHLNSYPYT

SEQ ID NO: 2897 - protein, 7 aa, Artificial Sequence
  Description of Artificial Sequence: Synthetic peptide
GGSINTY

SEQ ID NO: 2898 - protein, 5 aa, Artificial Sequence
  Description of Artificial Sequence: Synthetic peptide
YTSDN

SEQ ID NO: 2899 - protein, 9 aa, Artificial Sequence
  Description of Artificial Sequence: Synthetic peptide
YNWNYWYFD

SEQ ID NO: 2900 - protein, 7 aa, Artificial Sequence
  Description of Artificial Sequence: Synthetic peptide
SQGISSY

SEQ ID NO: 2901 - protein, 3 aa, Artificial Sequence
  Description of Artificial Sequence: Synthetic peptide
TAS

SEQ ID NO: 2902 - protein, 6 aa, Artificial Sequence
  Description of Artificial Sequence: Synthetic peptide
LNSYPY

SEQ ID NO: 2903 - protein, 10 aa, Artificial Sequence
  Description of Artificial Sequence: Synthetic peptide
GGSINTYYWS

SEQ ID NO: 2904 - protein, 9 aa, Artificial Sequence
  Description of Artificial Sequence: Synthetic peptide
RIYTSDNTN

SEQ ID NO: 2905 - protein, 10 aa, Artificial Sequence
  Description of Artificial Sequence: Synthetic peptide
YNWNYWYFDL

SEQ ID NO: 2906 - protein, 11 aa, Artificial Sequence
  Description of Artificial Sequence: Synthetic peptide
RASQGISSYLA

SEQ ID NO: 2907 - protein, 7 aa, Artificial Sequence
  Description of Artificial Sequence: Synthetic peptide
TASTLQS

SEQ ID NO: 2908 - protein, 9 aa, Artificial Sequence
  Description of Artificial Sequence: Synthetic peptide
QHLNSYPYT

SEQ ID NO: 2909 - protein, 6 aa, Artificial Sequence
  Description of Artificial Sequence: Synthetic peptide
NTYYWS

SEQ ID NO: 2910 - protein, 12 aa, Artificial Sequence
  Description of Artificial Sequence: Synthetic peptide
LIGRIYTSDNTN

SEQ ID NO: 2911 - protein, 11 aa, Artificial Sequence
  Description of Artificial Sequence: Synthetic peptide
ARYNWNYWYFD

SEQ ID NO: 2912 - protein, 7 aa, Artificial Sequence
  Description of Artificial Sequence: Synthetic peptide
SSYLAWY

SEQ ID NO: 2913 - protein, 10 aa, Artificial Sequence
  Description of Artificial Sequence: Synthetic peptide
LLIYTASTLQ

SEQ ID NO: 2914 - protein, 8 aa, Artificial Sequence
  Description of Artificial Sequence: Synthetic peptide
QHLNSYPY

SEQ ID NO: 2915 - protein, 8 aa, Artificial Sequence
  Description of Artificial Sequence: Synthetic peptide
GGSINTYY

SEQ ID NO: 2916 - protein, 7 aa, Artificial Sequence
  Description of Artificial Sequence: Synthetic peptide
IYTSDNT

SEQ ID NO: 2917 - protein, 12 aa, Artificial Sequence
  Description of Artificial Sequence: Synthetic peptide
ARYNWNYWYFDL

SEQ ID NO: 2918 - protein, 6 aa, Artificial Sequence
  Description of Artificial Sequence: Synthetic peptide
QGISSY

SEQ ID NO: 2919 - protein, 3 aa, Artificial Sequence
  Description of Artificial Sequence: Synthetic peptide
TAS

SEQ ID NO: 2920 - protein, 9 aa, Artificial Sequence
  Description of Artificial Sequence: Synthetic peptide
QHLNSYPYT

SEQ ID NO: 2921 - protein, 118 aa, Artificial Sequence
  Description of Artificial Sequence: Synthetic polypeptide
QVQLQESGPGLVKPSETLSLTCSVSGGSINTYYWSWFRQPAGKGLELIGRIYTSDNTNYNPSLKSRVTMSVDTSKNQFSLKLSSVTAADTAVYYCARYNWNYWYFDLWGRGTLVTVSS

SEQ ID NO: 2922 - protein, 107 aa, Artificial Sequence
  Description of Artificial Sequence: Synthetic polypeptide
DIQMTQSPSFLSASVRDRVNITCRASQGISSYLAWYQQKPGKAPKLLIYTASTLQSGVPSRFSGSGSGTEFTLTISSLQPEDFATYYCQHLNSYPYTFGQGTKVEIK

SEQ ID NO: 2923 - protein, 448 aa, Artificial Sequence
  Description of Artificial Sequence: Synthetic polypeptide
QVQLQESGPGLVKPSETLSLTCSVSGGSINTYYWSWFRQPAGKGLELIGRIYTSDNTNYNPSLKSRVTMSVDTSKNQFSLKLSSVTAADTAVYYCARYNWNYWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2924 - protein, 214 aa, Artificial Sequence
  Description of Artificial Sequence: Synthetic polypeptide
DIQMTQSPSFLSASVRDRVNITCRASQGISSYLAWYQQKPGKAPKLLIYTASTLQSGVPSRFSGSGSGTEFTLTISSLQPEDFATYYCQHLNSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2925 - protein, 5 aa, Artificial Sequence
  Description of Artificial Sequence: Synthetic peptide
HYYWN

SEQ ID NO: 2926 - protein, 16 aa, Artificial Sequence
  Description of Artificial Sequence: Synthetic peptide
RIYTSGSTNYNPSLKS

SEQ ID NO: 2927 - protein, 11 aa, Artificial Sequence
  Description of Artificial Sequence: Synthetic peptide
SGGNFYWYFDL

SEQ ID NO: 2928 - protein, 13 aa, Artificial Sequence
  Description of Artificial Sequence: Synthetic peptide
SGSSSNIGNNYVS

SEQ ID NO: 2929 - protein, 7 aa, Artificial Sequence
  Description of Artificial Sequence: Synthetic peptide
DNNKRPS

SEQ ID NO: 2930 - protein, 11 aa, Artificial Sequence
  Description of Artificial Sequence: Synthetic peptide
GTWDSSLSAGV

SEQ ID NO: 2931 - protein, 7 aa, Artificial Sequence
  Description of Artificial Sequence: Synthetic peptide
GDSIGHY

SEQ ID NO: 2932 - protein, 5 aa, Artificial Sequence
  Description of Artificial Sequence: Synthetic peptide
YTSGS

SEQ ID NO: 2933 - protein, 10 aa, Artificial Sequence
  Description of Artificial Sequence: Synthetic peptide
SGGNFYWYFD

SEQ ID NO: 2934 - protein, 9 aa, Artificial Sequence
  Description of Artificial Sequence: Synthetic peptide
SSSNIGNNY

SEQ ID NO: 2935 - protein, 3 aa, Artificial Sequence
  Description of Artificial Sequence: Synthetic peptide
DNN

SEQ ID NO: 2936 - protein, 8 aa, Artificial Sequence
  Description of Artificial Sequence: Synthetic peptide
WDSSLSAG

SEQ ID NO: 2937 - protein, 10 aa, Artificial Sequence
  Description of Artificial Sequence: Synthetic peptide
GDSIGHYYWN

SEQ ID NO: 2938 - protein, 9 aa, Artificial Sequence
  Description of Artificial Sequence: Synthetic peptide
RIYTSGSTN

SEQ ID NO: 2939 - protein, 11 aa, Artificial Sequence
  Description of Artificial Sequence: Synthetic peptide
SGGNFYWYFDL

SEQ ID NO: 2940 - protein, 13 aa, Artificial Sequence
  Description of Artificial Sequence: Synthetic peptide
SGSSSNIGNNYVS

SEQ ID NO: 2941 - protein, 7 aa, Artificial Sequence
  Description of Artificial Sequence: Synthetic peptide
DNNKRPS

SEQ ID NO: 2942 - protein, 11 aa, Artificial Sequence
  Description of Artificial Sequence: Synthetic peptide
GTWDSSLSAGV

SEQ ID NO: 2943 - protein, 6 aa, Artificial Sequence
  Description of Artificial Sequence: Synthetic peptide
GHYYWN

SEQ ID NO: 2944 - protein, 12 aa, Artificial Sequence
  Description of Artificial Sequence: Synthetic peptide
WIGRIYTSGSTN

SEQ ID NO: 2945 - protein, 12 aa, Artificial Sequence
  Description of Artificial Sequence: Synthetic peptide
ARSGGNFYWYFD

SEQ ID NO: 2946 - protein, 9 aa, Artificial Sequence
  Description of Artificial Sequence: Synthetic peptide
IGNNYVSWY

SEQ ID NO: 2947 - protein, 10 aa, Artificial Sequence
  Description of Artificial Sequence: Synthetic peptide
LLIYDNNKRP

SEQ ID NO: 2948 - protein, 10 aa, Artificial Sequence
  Description of Artificial Sequence: Synthetic peptide
GTWDSSLSAG

SEQ ID NO: 2949 - protein, 8 aa, Artificial Sequence
  Description of Artificial Sequence: Synthetic peptide
GDSIGHYY

SEQ ID NO: 2950 - protein, 7 aa, Artificial Sequence
  Description of Artificial Sequence: Synthetic peptide
IYTSGST

SEQ ID NO: 2951 - protein, 13 aa, Artificial Sequence
  Description of Artificial Sequence: Synthetic peptide
ARSGGNFYWYFDL

SEQ ID NO: 2952 - protein, 8 aa, Artificial Sequence
  Description of Artificial Sequence: Synthetic peptide
SSNIGNNY

SEQ ID NO: 2953 - protein, 3 aa, Artificial Sequence
  Description of Artificial Sequence: Synthetic peptide
DNN

SEQ ID NO: 2954 - protein, 11 aa, Artificial Sequence
  Description of Artificial Sequence: Synthetic peptide
GTWDSSLSAGV

SEQ ID NO: 2955 - protein, 119 aa, Artificial Sequence
  Description of Artificial Sequence: Synthetic polypeptide
QVQLVQSGPGLVKPSETLSLTCTVSGDSIGHYYWNWIRQPAGKGLEWIGRIYTSGSTNYNPSLKSRVTMSVDTSKNQFSLKLSSVTAADTAVYYCARSGGNFYWYFDLWGRGTLVTVSS

SEQ ID NO: 2956 - protein, 110 aa, Artificial Sequence
  Description of Artificial Sequence: Synthetic polypeptide
QSVLTQPPSVSAAPGQKVTISCSGSSSNIGNNYVSWYQQVPGTAPKLLIYDNNKRPSGIPDRISGSKSGTSATLGITGLQTGDEADYYCGTWDSSLSAGVFGGGTKVTVL

SEQ ID NO: 2957 - protein, 449 aa, Artificial Sequence
  Description of Artificial Sequence: Synthetic polypeptide
QVQLVQSGPGLVKPSETLSLTCTVSGDSIGHYYWNWIRQPAGKGLEWIGRIYTSGSTNYNPSLKSRVTMSVDTSKNQFSLKLSSVTAADTAVYYCARSGGNFYWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2958 - protein, 216 aa, Artificial Sequence
  Description of Artificial Sequence: Synthetic polypeptide
QSVLTQPPSVSAAPGQKVTISCSGSSSNIGNNYVSWYQQVPGTAPKLLIYDNNKRPSGIPDRISGSKSGTSATLGITGLQTGDEADYYCGTWDSSLSAGVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2959 - protein, 5 aa, Artificial Sequence
  Description of Artificial Sequence: Synthetic peptide
NYYWS

SEQ ID NO: 2960 - protein, 16 aa, Artificial Sequence
  Description of Artificial Sequence: Synthetic peptide
RIYPSGITSYDPSLKS

SEQ ID NO: 2961 - protein, 10 aa, Artificial Sequence
  Description of Artificial Sequence: Synthetic peptide
IMGTKGAFDI

SEQ ID NO: 2962 - protein, 14 aa, Artificial Sequence
  Description of Artificial Sequence: Synthetic peptide
TGTSSDVGGYNYVS

SEQ ID NO: 2963 - protein, 7 aa, Artificial Sequence
  Description of Artificial Sequence: Synthetic peptide
EVSNRPS

SEQ ID NO: 2964 - protein, 9 aa, Artificial Sequence
  Description of Artificial Sequence: Synthetic peptide
SSYTSTSVV

SEQ ID NO: 2965 - protein, 7 aa, Artificial Sequence
  Description of Artificial Sequence: Synthetic peptide
GGSISNY

SEQ ID NO: 2966 - protein, 5 aa, Artificial Sequence
  Description of Artificial Sequence: Synthetic peptide
YPSGI

SEQ ID NO: 2967 - protein, 9 aa, Artificial Sequence
  Description of Artificial Sequence: Synthetic peptide
IMGTKGAFD

SEQ ID NO: 2968 - protein, 10 aa, Artificial Sequence
  Description of Artificial Sequence: Synthetic peptide
TSSDVGGYNY

SEQ ID NO: 2969 - protein, 3 aa, Artificial Sequence
  Description of Artificial Sequence: Synthetic peptide
EVS

SEQ ID NO: 2970 - protein, 6 aa, Artificial Sequence
  Description of Artificial Sequence: Synthetic peptide
YTSTSV

SEQ ID NO: 2971 - protein, 10 aa, Artificial Sequence
  Description of Artificial Sequence: Synthetic peptide
GGSISNYYWS

SEQ ID NO: 2972 - protein, 9 aa, Artificial Sequence
  Description of Artificial Sequence: Synthetic peptide
RIYPSGITS

SEQ ID NO: 2973 - protein, 10 aa, Artificial Sequence
  Description of Artificial Sequence: Synthetic peptide
IMGTKGAFDI

SEQ ID NO: 2974 - protein, 14 aa, Artificial Sequence
  Description of Artificial Sequence: Synthetic peptide
TGTSSDVGGYNYVS

SEQ ID NO: 2975 - protein, 7 aa, Artificial Sequence
  Description of Artificial Sequence: Synthetic peptide
EVSNRPS

SEQ ID NO: 2976 - protein, 9 aa, Artificial Sequence
  Description of Artificial Sequence: Synthetic peptide
SSYTSTSVV

SEQ ID NO: 2977 - protein, 6 aa, Artificial Sequence
  Description of Artificial Sequence: Synthetic peptide
SNYYWS

SEQ ID NO: 2978 - protein, 12 aa, Artificial Sequence
  Description of Artificial Sequence: Synthetic peptide
WIGRIYPSGITS

SEQ ID NO: 2979 - protein, 11 aa, Artificial Sequence
  Description of Artificial Sequence: Synthetic peptide
AGIMGTKGAFD

SEQ ID NO: 2980 - protein, 10 aa, Artificial Sequence
  Description of Artificial Sequence: Synthetic peptide
VGGYNYVSWY

SEQ ID NO: 2981 - protein, 10 aa, Artificial Sequence
  Description of Artificial Sequence: Synthetic peptide
LLIYEVSNRP

SEQ ID NO: 2982 - protein, 8 aa, Artificial Sequence
  Description of Artificial Sequence: Synthetic peptide
SSYTSTSV

SEQ ID NO: 2983 - protein, 8 aa, Artificial Sequence
  Description of Artificial Sequence: Synthetic peptide
GGSISNYY

SEQ ID NO: 2984 - protein, 7 aa, Artificial Sequence
  Description of Artificial Sequence: Synthetic peptide
IYPSGIT

SEQ ID NO: 2985 - protein, 12 aa, Artificial Sequence
  Description of Artificial Sequence: Synthetic peptide
AGIMGTKGAFDI

SEQ ID NO: 2986 - protein, 9 aa, Artificial Sequence
  Description of Artificial Sequence: Synthetic peptide
SSDVGGYNY

SEQ ID NO: 2987 - protein, 3 aa, Artificial Sequence
  Description of Artificial Sequence: Synthetic peptide
EVS

SEQ ID NO: 2988 - protein, 9 aa, Artificial Sequence
  Description of Artificial Sequence: Synthetic peptide
SSYTSTSVV

SEQ ID NO: 2989 - protein, 118 aa, Artificial Sequence
  Description of Artificial Sequence: Synthetic polypeptide
QVQLQESGPGLVKPSETLSLTCTVSGGSISNYYWSWIRQPAGKGLEWIGRIYPSGITSYDPSLKSRVTMSLDTSKNQFSLKLTSVTAADTAVYYCAGIMGTKGAFDIWGQGTMVTVSS

SEQ ID NO: 2990 - protein, 109 aa, Artificial Sequence
  Description of Artificial Sequence: Synthetic polypeptide
QSALTQPASVSGSPGQSITISCTGTSSDVGGYNYVSWYQQHPGKAPKLLIYEVSNRPSGVSNRFSGSKSGSTASLTISGLQAEDEADYYCSSYTSTSVVFGGGTKLTVL

SEQ ID NO: 2991 - protein, 448 aa, Artificial Sequence
  Description of Artificial Sequence: Synthetic polypeptide
QVQLQESGPGLVKPSETLSLTCTVSGGSISNYYWSWIRQPAGKGLEWIGRIYPSGITSYDPSLKSRVTMSLDTSKNQFSLKLTSVTAADTAVYYCAGIMGTKGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2992 - protein, 215 aa, Artificial Sequence
  Description of Artificial Sequence: Synthetic polypeptide
QSALTQPASVSGSPGQSITISCTGTSSDVGGYNYVSWYQQHPGKAPKLLIYEVSNRPSGVSNRFSGSKSGSTASLTISGLQAEDEADYYCSSYTSTSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2993 - protein, 5 aa, Artificial Sequence
  Description of Artificial Sequence: Synthetic peptide
SYAIS

SEQ ID NO: 2994 - protein, 17 aa, Artificial Sequence
  Description of Artificial Sequence: Synthetic peptide
GIIPIFGTATYAQKFQD

SEQ ID NO: 2995 - protein, 14 aa, Artificial Sequence
  Description of Artificial Sequence: Synthetic peptide
GVGWGTDYYYGLDV

SEQ ID NO: 2996 - protein, 16 aa, Artificial Sequence
  Description of Artificial Sequence: Synthetic peptide
RSSQGLVHSDGNTYLS

SEQ ID NO: 2997 - protein, 7 aa, Artificial Sequence
  Description of Artificial Sequence: Synthetic peptide
KISNRFS

SEQ ID NO: 2998 - protein, 9 aa, Artificial Sequence
  Description of Artificial Sequence: Synthetic peptide
MQATHHPLT

SEQ ID NO: 2999 - protein, 7 aa, Artificial Sequence
  Description of Artificial Sequence: Synthetic peptide
GGTFSSY

SEQ ID NO: 3000 - protein, 6 aa, Artificial Sequence
  Description of Artificial Sequence: Synthetic peptide
IPIFGT

SEQ ID NO: 3001 - protein, 13 aa, Artificial Sequence
  Description of Artificial Sequence: Synthetic peptide
GVGWGTDYYYGLD

SEQ ID NO: 3002 - protein, 12 aa, Artificial Sequence
  Description of Artificial Sequence: Synthetic peptide
SQGLVHSDGNTY

SEQ ID NO: 3003 - protein, 3 aa, Artificial Sequence
  Description of Artificial Sequence: Synthetic peptide
KIS

SEQ ID NO: 3004 - protein, 6 aa, Artificial Sequence
  Description of Artificial Sequence: Synthetic peptide
ATHHPL

SEQ ID NO: 3005 - protein, 10 aa, Artificial Sequence
  Description of Artificial Sequence: Synthetic peptide
GGTFSSYAIS

SEQ ID NO: 3006 - protein, 10 aa, Artificial Sequence
  Description of Artificial Sequence: Synthetic peptide
GIIPIFGTAT

SEQ ID NO: 3007 - protein, 14 aa, Artificial Sequence
  Description of Artificial Sequence: Synthetic peptide
GVGWGTDYYYGLDV

SEQ ID NO: 3008 - protein, 16 aa, Artificial Sequence
  Description of Artificial Sequence: Synthetic peptide
RSSQGLVHSDGNTYLS

SEQ ID NO: 3009 - protein, 7 aa, Artificial Sequence
  Description of Artificial Sequence: Synthetic peptide
KISNRFS

SEQ ID NO: 3010 - protein, 9 aa, Artificial Sequence
  Description of Artificial Sequence: Synthetic peptide
MQATHHPLT

SEQ ID NO: 3011 - protein, 6 aa, Artificial Sequence
  Description of Artificial Sequence: Synthetic peptide
SSYAIS

SEQ ID NO: 3012 - protein, 13 aa, Artificial Sequence
  Description of Artificial Sequence: Synthetic peptide
WMGGIIPIFGTAT

SEQ ID NO: 3013 - protein, 15 aa, Artificial Sequence
  Description of Artificial Sequence: Synthetic peptide
ARGVGWGTDYYYGLD

SEQ ID NO: 3014 - protein, 12 aa, Artificial Sequence
  Description of Artificial Sequence: Synthetic peptide
VHSDGNTYLSWL

SEQ ID NO: 3015 - protein, 10 aa, Artificial Sequence
  Description of Artificial Sequence: Synthetic peptide
LLIYKISNRF

SEQ ID NO: 3016 - protein, 8 aa, Artificial Sequence
  Description of Artificial Sequence: Synthetic peptide
MQATHHPL

SEQ ID NO: 3017 - protein, 8 aa, Artificial Sequence
  Description of Artificial Sequence: Synthetic peptide
GGTFSSYA

SEQ ID NO: 3018 - protein, 8 aa, Artificial Sequence
  Description of Artificial Sequence: Synthetic peptide
IIPIFGTA

SEQ ID NO: 3019 - protein, 16 aa, Artificial Sequence
  Description of Artificial Sequence: Synthetic peptide
ARGVGWGTDYYYGLDV

SEQ ID NO: 3020 - protein, 11 aa, Artificial Sequence
  Description of Artificial Sequence: Synthetic peptide
QGLVHSDGNTY

SEQ ID NO: 3021 - protein, 3 aa, Artificial Sequence
  Description of Artificial Sequence: Synthetic peptide
KIS

SEQ ID NO: 3022 - protein, 9 aa, Artificial Sequence
  Description of Artificial Sequence: Synthetic peptide
MQATHHPLT

SEQ ID NO: 3023 - protein, 123 aa, Artificial Sequence
  Description of Artificial Sequence: Synthetic polypeptide
EVQLVQSGAEVKKPGSSVKVSCKTSGGTFSSYAISWVRQAPGQGLEWMGGIIPIFGTATYAQKFQDRVTITADKSTSTAYMELSSLRSEDTAVFYCARGVGWGTDYYYGLDVWGQGTTVTVSS

SEQ ID NO: 3024 - protein, 112 aa, Artificial Sequence
  Description of Artificial Sequence: Synthetic polypeptide
ETTLTQSPLSSPVTLGQPASISCRSSQGLVHSDGNTYLSWLQQRPGQSPRLLIYKISNRFSGVPDRFSGSGAGTDFTLKISRVEAEDVGVYYCMQATHHPLTFGGGTKVEIK

SEQ ID NO: 3025 - protein, 453 aa, Artificial Sequence
  Description of Artificial Sequence: Synthetic polypeptide
EVQLVQSGAEVKKPGSSVKVSCKTSGGTFSSYAISWVRQAPGQGLEWMGGIIPIFGTATYAQKFQDRVTITADKSTSTAYMELSSLRSEDTAVFYCARGVGWGTDYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3026 - protein, 219 aa, Artificial Sequence
  Description of Artificial Sequence: Synthetic polypeptide
ETTLTQSPLSSPVTLGQPASISCRSSQGLVHSDGNTYLSWLQQRPGQSPRLLIYKISNRFSGVPDRFSGSGAGTDFTLKISRVEAEDVGVYYCMQATHHPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3027 - protein, 5 aa, Artificial Sequence
  Description of Artificial Sequence: Synthetic peptide
NYYWS

SEQ ID NO: 3028 - protein, 16 aa, Artificial Sequence
  Description of Artificial Sequence: Synthetic peptide
RIYSSGITNYNPSLKS

SEQ ID NO: 3029 - protein, 10 aa, Artificial Sequence
  Description of Artificial Sequence: Synthetic peptide
IVGVKGAFAI

SEQ ID NO: 3030 - protein, 14 aa, Artificial Sequence
  Description of Artificial Sequence: Synthetic peptide
TGTSSDVGGYNYVS

SEQ ID NO: 3031 - protein, 7 aa, Artificial Sequence
  Description of Artificial Sequence: Synthetic peptide
EVSNRPS

SEQ ID NO: 3032 - protein, 9 aa, Artificial Sequence
  Description of Artificial Sequence: Synthetic peptide
SSYTSTSVV

SEQ ID NO: 3033 - protein, 7 aa, Artificial Sequence
  Description of Artificial Sequence: Synthetic peptide
GGSISNY

SEQ ID NO: 3034 - protein, 5 aa, Artificial Sequence
  Description of Artificial Sequence: Synthetic peptide
YSSGI

SEQ ID NO: 3035 - protein, 9 aa, Artificial Sequence
  Description of Artificial Sequence: Synthetic peptide
IVGVKGAFA

SEQ ID NO: 3036 - protein, 10 aa, Artificial Sequence
  Description of Artificial Sequence: Synthetic peptide
TSSDVGGYNY

SEQ ID NO: 3037 - protein, 3 aa, Artificial Sequence
  Description of Artificial Sequence: Synthetic peptide
EVS

SEQ ID NO: 3038 - protein, 6 aa, Artificial Sequence
  Description of Artificial Sequence: Synthetic peptide
YTSTSV

SEQ ID NO: 3039 - protein, 10 aa, Artificial Sequence
  Description of Artificial Sequence: Synthetic peptide
GGSISNYYWS

SEQ ID NO: 3040 - protein, 9 aa, Artificial Sequence
  Description of Artificial Sequence: Synthetic peptide
RIYSSGITN

SEQ ID NO: 3041 - protein, 10 aa, Artificial Sequence
  Description of Artificial Sequence: Synthetic peptide
IVGVKGAFAI

SEQ ID NO: 3042 - protein, 14 aa, Artificial Sequence
  Description of Artificial Sequence: Synthetic peptide
TGTSSDVGGYNYVS

SEQ ID NO: 3043 - protein, 7 aa, Artificial Sequence
  Description of Artificial Sequence: Synthetic peptide
EVSNRPS

SEQ ID NO: 3044 - protein, 9 aa, Artificial Sequence
  Description of Artificial Sequence: Synthetic peptide
SSYTSTSVV

SEQ ID NO: 3045 - protein, 6 aa, Artificial Sequence
  Description of Artificial Sequence: Synthetic peptide
SNYYWS

SEQ ID NO: 3046 - protein, 12 aa, Artificial Sequence
  Description of Artificial Sequence: Synthetic peptide
WIGRIYSSGITN

SEQ ID NO: 3047 - protein, 11 aa, Artificial Sequence
  Description of Artificial Sequence: Synthetic peptide
AGIVGVKGAFA

SEQ ID NO: 3048 - protein, 10 aa, Artificial Sequence
  Description of Artificial Sequence: Synthetic peptide
VGGYNYVSWY

SEQ ID NO: 3049 - protein, 10 aa, Artificial Sequence
  Description of Artificial Sequence: Synthetic peptide
LMIYEVSNRP

SEQ ID NO: 3050 - protein, 8 aa, Artificial Sequence
  Description of Artificial Sequence: Synthetic peptide
SSYTSTSV

SEQ ID NO: 3051 - protein, 8 aa, Artificial Sequence
  Description of Artificial Sequence: Synthetic peptide
GGSISNYY

SEQ ID NO: 3052 - protein, 7 aa, Artificial Sequence
  Description of Artificial Sequence: Synthetic peptide
IYSSGIT

SEQ ID NO: 3053 - protein, 12 aa, Artificial Sequence
  Description of Artificial Sequence: Synthetic peptide
AGIVGVKGAFAI

SEQ ID NO: 3054 - protein, 9 aa, Artificial Sequence
  Description of Artificial Sequence: Synthetic peptide
SSDVGGYNY

SEQ ID NO: 3055 - protein, 3 aa, Artificial Sequence
  Description of Artificial Sequence: Synthetic peptide
EVS

SEQ ID NO: 3056 - protein, 9 aa, Artificial Sequence
  Description of Artificial Sequence: Synthetic peptide
SSYTSTSVV

SEQ ID NO: 3057 - protein, 118 aa, Artificial Sequence
  Description of Artificial Sequence: Synthetic polypeptide
QVQLQQSGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTMVTVSS

SEQ ID NO: 3058 - protein, 109 aa, Artificial Sequence
  Description of Artificial Sequence: Synthetic polypeptide
QSVLTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKLTVL

SEQ ID NO: 3059 - protein, 448 aa, Artificial Sequence
  Description of Artificial Sequence: Synthetic polypeptide
QVQLQQSGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3060 - protein, 215 aa, Artificial Sequence
  Description of Artificial Sequence: Synthetic polypeptide
QSVLTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3061 - protein, 5 aa, Artificial Sequence
  Description of Artificial Sequence: Synthetic peptide
NYYWS

SEQ ID NO: 3062 - protein, 16 aa, Artificial Sequence
  Description of Artificial Sequence: Synthetic peptide
RIYSSGITNYNPSLKS

SEQ ID NO: 3063 - protein, 10 aa, Artificial Sequence
  Description of Artificial Sequence: Synthetic peptide
IVGVKGAFAI

SEQ ID NO: 3064 - protein, 14 aa, Artificial Sequence
  Description of Artificial Sequence: Synthetic peptide
TGTSSDVGGYNYVS

SEQ ID NO: 3065 - protein, 7 aa, Artificial Sequence
  Description of Artificial Sequence: Synthetic peptide
EVSNRPS

SEQ ID NO: 3066 - protein, 9 aa, Artificial Sequence
  Description of Artificial Sequence: Synthetic peptide
SSYTSTSVV

SEQ ID NO: 3067 - protein, 7 aa, Artificial Sequence
  Description of Artificial Sequence: Synthetic peptide
GGSISNY

SEQ ID NO: 3068 - protein, 5 aa, Artificial Sequence
  Description of Artificial Sequence: Synthetic peptide
YSSGI

SEQ ID NO: 3069 - protein, 9 aa, Artificial Sequence
  Description of Artificial Sequence: Synthetic peptide
IVGVKGAFA

SEQ ID NO: 3070 - protein, 10 aa, Artificial Sequence
  Description of Artificial Sequence: Synthetic peptide
TSSDVGGYNY

SEQ ID NO: 3071 - protein, 3 aa, Artificial Sequence
  Description of Artificial Sequence: Synthetic peptide
EVS

SEQ ID NO: 3072 - protein, 6 aa, Artificial Sequence
  Description of Artificial Sequence: Synthetic peptide
YTSTSV

SEQ ID NO: 3073 - protein, 10 aa, Artificial Sequence
  Description of Artificial Sequence: Synthetic peptide
GGSISNYYWS

SEQ ID NO: 3074 - protein, 9 aa, Artificial Sequence
  Description of Artificial Sequence: Synthetic peptide
RIYSSGITN

SEQ ID NO: 3075 - protein, 10 aa, Artificial Sequence
  Description of Artificial Sequence: Synthetic peptide
IVGVKGAFAI

SEQ ID NO: 3076 - protein, 14 aa, Artificial Sequence
  Description of Artificial Sequence: Synthetic peptide
TGTSSDVGGYNYVS

SEQ ID NO: 3077 - protein, 7 aa, Artificial Sequence
  Description of Artificial Sequence: Synthetic peptide
EVSNRPS

SEQ ID NO: 3078 - protein, 9 aa, Artificial Sequence
  Description of Artificial Sequence: Synthetic peptide
SSYTSTSVV

SEQ ID NO: 3079 - protein, 6 aa, Artificial Sequence
  Description of Artificial Sequence: Synthetic peptide
SNYYWS

SEQ ID NO: 3080 - protein, 12 aa, Artificial Sequence
  Description of Artificial Sequence: Synthetic peptide
WIGRIYSSGITN

SEQ ID NO: 3081 - protein, 11 aa, Artificial Sequence
  Description of Artificial Sequence: Synthetic peptide
AGIVGVKGAFA

SEQ ID NO: 3082 - protein, 10 aa, Artificial Sequence
  Description of Artificial Sequence: Synthetic peptide
VGGYNYVSWY

SEQ ID NO: 3083 - protein, 10 aa, Artificial Sequence
  Description of Artificial Sequence: Synthetic peptide
LMIYEVSNRP

SEQ ID NO: 3084 - protein, 8 aa, Artificial Sequence
  Description of Artificial Sequence: Synthetic peptide
SSYTSTSV

SEQ ID NO: 3085 - protein, 8 aa, Artificial Sequence
  Description of Artificial Sequence: Synthetic peptide
GGSISNYY

SEQ ID NO: 3086 - protein, 7 aa, Artificial Sequence
  Description of Artificial Sequence: Synthetic peptide
IYSSGIT

SEQ ID NO: 3087 - protein, 12 aa, Artificial Sequence
  Description of Artificial Sequence: Synthetic peptide
AGIVGVKGAFAI

SEQ ID NO: 3088 - protein, 9 aa, Artificial Sequence
  Description of Artificial Sequence: Synthetic peptide
SSDVGGYNY

SEQ ID NO: 3089 - protein, 3 aa, Artificial Sequence
  Description of Artificial Sequence: Synthetic peptide
EVS

SEQ ID NO: 3090 - protein, 9 aa, Artificial Sequence
  Description of Artificial Sequence: Synthetic peptide
SSYTSTSVV

SEQ ID NO: 3091 - protein, 118 aa, Artificial Sequence
  Description of Artificial Sequence: Synthetic polypeptide
QVTLKESGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTMVTVSS

SEQ ID NO: 3092 - protein, 109 aa, Artificial Sequence
  Description of Artificial Sequence: Synthetic polypeptide
QPVLTQSSSVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKVTVL

SEQ ID NO: 3093 - protein, 448 aa, Artificial Sequence
  Description of Artificial Sequence: Synthetic polypeptide
QVTLKESGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3094 - protein, 215 aa, Artificial Sequence
  Description of Artificial Sequence: Synthetic polypeptide
QPVLTQSSSVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3095 - protein, 5 aa, Artificial Sequence
  Description of Artificial Sequence: Synthetic peptide
GYYLH

SEQ ID NO: 3096 - protein, 17 aa, Artificial Sequence
  Description of Artificial Sequence: Synthetic peptide
WINPSSGDTDYAQTFQG

SEQ ID NO: 3097 - protein, 9 aa, Artificial Sequence
  Description of Artificial Sequence: Synthetic peptide
ELGIGVFDY

SEQ ID NO: 3098 - protein, 17 aa, Artificial Sequence
  Description of Artificial Sequence: Synthetic peptide
KSSQSVLYSSNNKNYLG

SEQ ID NO: 3099 - protein, 7 aa, Artificial Sequence
  Description of Artificial Sequence: Synthetic peptide
WASTRES

SEQ ID NO: 3100 - protein, 9 aa, Artificial Sequence
  Description of Artificial Sequence: Synthetic peptide
QQYYSIPYT

SEQ ID NO: 3101 - protein, 7 aa, Artificial Sequence
  Description of Artificial Sequence: Synthetic peptide
GYTFTGY

SEQ ID NO: 3102 - protein, 6 aa, Artificial Sequence
  Description of Artificial Sequence: Synthetic peptide
NPSSGD

SEQ ID NO: 3103 - protein, 8 aa, Artificial Sequence
  Description of Artificial Sequence: Synthetic peptide
ELGIGVFD

SEQ ID NO: 3104 - protein, 13 aa, Artificial Sequence
  Description of Artificial Sequence: Synthetic peptide
SQSVLYSSNNKNY

SEQ ID NO: 3105 - protein, 3 aa, Artificial Sequence
  Description of Artificial Sequence: Synthetic peptide
WAS

SEQ ID NO: 3106 - protein, 6 aa, Artificial Sequence
  Description of Artificial Sequence: Synthetic peptide
YYSIPY

SEQ ID NO: 3107 - protein, 10 aa, Artificial Sequence
  Description of Artificial Sequence: Synthetic peptide
GYTFTGYYLH

SEQ ID NO: 3108 - protein, 10 aa, Artificial Sequence
  Description of Artificial Sequence: Synthetic peptide
WINPSSGDTD

SEQ ID NO: 3109 - protein, 9 aa, Artificial Sequence
  Description of Artificial Sequence: Synthetic peptide
ELGIGVFDY

SEQ ID NO: 3110 - protein, 17 aa, Artificial Sequence
  Description of Artificial Sequence: Synthetic peptide
KSSQSVLYSSNNKNYLG

SEQ ID NO: 3111 - protein, 7 aa, Artificial Sequence
  Description of Artificial Sequence: Synthetic peptide
WASTRES

SEQ ID NO: 3112 - protein, 9 aa, Artificial Sequence
  Description of Artificial Sequence: Synthetic peptide
QQYYSIPYT

SEQ ID NO: 3113 - protein, 6 aa, Artificial Sequence
  Description of Artificial Sequence: Synthetic peptide
TGYYLH

SEQ ID NO: 3114 - protein, 13 aa, Artificial Sequence
  Description of Artificial Sequence: Synthetic peptide
WVGWINPSSGDTD

SEQ ID NO: 3115 - protein, 10 aa, Artificial Sequence
  Description of Artificial Sequence: Synthetic peptide
ANELGIGVFD

SEQ ID NO: 3116 - protein, 13 aa, Artificial Sequence
  Description of Artificial Sequence: Synthetic peptide
LYSSNNKNYLGWY

SEQ ID NO: 3117 - protein, 10 aa, Artificial Sequence
  Description of Artificial Sequence: Synthetic peptide
LLIYWASTRE

SEQ ID NO: 3118 - protein, 8 aa, Artificial Sequence
  Description of Artificial Sequence: Synthetic peptide
QQYYSIPY

SEQ ID NO: 3119 - protein, 8 aa, Artificial Sequence
  Description of Artificial Sequence: Synthetic peptide
GYTFTGYY

SEQ ID NO: 3120 - protein, 8 aa, Artificial Sequence
  Description of Artificial Sequence: Synthetic peptide
INPSSGDT

SEQ ID NO: 3121 - protein, 11 aa, Artificial Sequence
  Description of Artificial Sequence: Synthetic peptide
ANELGIGVFDY

SEQ ID NO: 3122 - protein, 12 aa, Artificial Sequence
  Description of Artificial Sequence: Synthetic peptide
QSVLYSSNNKNY

SEQ ID NO: 3123 - protein, 3 aa, Artificial Sequence
  Description of Artificial Sequence: Synthetic peptide
WAS

SEQ ID NO: 3124 - protein, 9 aa, Artificial Sequence
  Description of Artificial Sequence: Synthetic peptide
QQYYSIPYT

SEQ ID NO: 3125 - protein, 118 aa, Artificial Sequence
  Description of Artificial Sequence: Synthetic polypeptide
EVQLVQSGAEVKKPGASVKVSCKASGYTFTGYYLHWVRQAPGQGLEWVGWINPSSGDTDYAQTFQGRVTMTRDTSISTAYMELSRLRSDDTAVYYCANELGIGVFDYWGQGTLVTVSS

SEQ ID NO: 3126 - protein, 113 aa, Artificial Sequence
  Description of Artificial Sequence: Synthetic polypeptide
DIVMTQSPDSLAVSLGERATINCKSSQSVLYSSNNKNYLGWYQQKPGQPPKLLIYWASTRESGVPDRFSGSGSGTDFTLTISSLQAEDVAVYFCQQYYSIPYTFGQGTKVDIK

SEQ ID NO: 3127 - protein, 448 aa, Artificial Sequence
  Description of Artificial Sequence: Synthetic polypeptide
EVQLVQSGAEVKKPGASVKVSCKASGYTFTGYYLHWVRQAPGQGLEWVGWINPSSGDTDYAQTFQGRVTMTRDTSISTAYMELSRLRSDDTAVYYCANELGIGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3128 - protein, 220 aa, Artificial Sequence
  Description of Artificial Sequence: Synthetic polypeptide
DIVMTQSPDSLAVSLGERATINCKSSQSVLYSSNNKNYLGWYQQKPGQPPKLLIYWASTRESGVPDRFSGSGSGTDFTLTISSLQAEDVAVYFCQQYYSIPYTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3129 - protein, 7 aa, Artificial Sequence
  Description of Artificial Sequence: Synthetic peptide
TYGVGVG

SEQ ID NO: 3130 - protein, 16 aa, Artificial Sequence
  Description of Artificial Sequence: Synthetic peptide
LIYWNDDKRYNPSLKS

SEQ ID NO: 3131 - protein, 10 aa, Artificial Sequence
  Description of Artificial Sequence: Synthetic peptide
ESDWSYYFDY

SEQ ID NO: 3132 - protein, 11 aa, Artificial Sequence
  Description of Artificial Sequence: Synthetic peptide
RASQSVSSYLA

SEQ ID NO: 3133 - protein, 7 aa, Artificial Sequence
  Description of Artificial Sequence: Synthetic peptide
DASNRAT

SEQ ID NO: 3134 - protein, 9 aa, Artificial Sequence
  Description of Artificial Sequence: Synthetic peptide
QQRSSWPWT

SEQ ID NO: 3135 - protein, 9 aa, Artificial Sequence
  Description of Artificial Sequence: Synthetic peptide
GFSLSTYGV

SEQ ID NO: 3136 - protein, 5 aa, Artificial Sequence
  Description of Artificial Sequence: Synthetic peptide
YWNDD

SEQ ID NO: 3137 - protein, 9 aa, Artificial Sequence
  Description of Artificial Sequence: Synthetic peptide
ESDWSYYFD

SEQ ID NO: 3138 - protein, 7 aa, Artificial Sequence
  Description of Artificial Sequence: Synthetic peptide
SQSVSSY

SEQ ID NO: 3139 - protein, 3 aa, Artificial Sequence
  Description of Artificial Sequence: Synthetic peptide
DAS

SEQ ID NO: 3140 - protein, 6 aa, Artificial Sequence
  Description of Artificial Sequence: Synthetic peptide
RSSWPW

SEQ ID NO: 3141 - protein, 12 aa, Artificial Sequence
  Description of Artificial Sequence: Synthetic peptide
GFSLSTYGVGVG

SEQ ID NO: 3142 - protein, 9 aa, Artificial Sequence
  Description of Artificial Sequence: Synthetic peptide
LIYWNDDKR

SEQ ID NO: 3143 - protein, 10 aa, Artificial Sequence
  Description of Artificial Sequence: Synthetic peptide
ESDWSYYFDY

SEQ ID NO: 3144 - protein, 11 aa, Artificial Sequence
  Description of Artificial Sequence: Synthetic peptide
RASQSVSSYLA

SEQ ID NO: 3145 - protein, 7 aa, Artificial Sequence
  Description of Artificial Sequence: Synthetic peptide
DASNRAT

SEQ ID NO: 3146 - protein, 9 aa, Artificial Sequence
  Description of Artificial Sequence: Synthetic peptide
QQRSSWPWT

SEQ ID NO: 3147 - protein, 8 aa, Artificial Sequence
  Description of Artificial Sequence: Synthetic peptide
STYGVGVG

SEQ ID NO: 3148 - protein, 12 aa, Artificial Sequence
  Description of Artificial Sequence: Synthetic peptide
WLALIYWNDDKR

SEQ ID NO: 3149 - protein, 11 aa, Artificial Sequence
  Description of Artificial Sequence: Synthetic peptide
SHESDWSYYFD

SEQ ID NO: 3150 - protein, 7 aa, Artificial Sequence
  Description of Artificial Sequence: Synthetic peptide
SSYLAWY

SEQ ID NO: 3151 - protein, 10 aa, Artificial Sequence
  Description of Artificial Sequence: Synthetic peptide
LLIYDASNRA

SEQ ID NO: 3152 - protein, 8 aa, Artificial Sequence
  Description of Artificial Sequence: Synthetic peptide
QQRSSWPW

SEQ ID NO: 3153 - protein, 10 aa, Artificial Sequence
  Description of Artificial Sequence: Synthetic peptide
GFSLSTYGVG

SEQ ID NO: 3154 - protein, 7 aa, Artificial Sequence
  Description of Artificial Sequence: Synthetic peptide
IYWNDDK

SEQ ID NO: 3155 - protein, 12 aa, Artificial Sequence
  Description of Artificial Sequence: Synthetic peptide
SHESDWSYYFDY

SEQ ID NO: 3156 - protein, 6 aa, Artificial Sequence
  Description of Artificial Sequence: Synthetic peptide
QSVSSY

SEQ ID NO: 3157 - protein, 3 aa, Artificial Sequence
  Description of Artificial Sequence: Synthetic peptide
DAS

SEQ ID NO: 3158 - protein, 9 aa, Artificial Sequence
  Description of Artificial Sequence: Synthetic peptide
QQRSSWPWT

SEQ ID NO: 3159 - protein, 120 aa, Artificial Sequence
  Description of Artificial Sequence: Synthetic polypeptide
QVTLRESGPTLVKPTQTLTLTCTFSGFSLSTYGVGVGWIRQPPGKALEWLALIYWNDDKRYNPSLKSRLTITKDTSKNQVVLTMTNMDPVGTATYYCSHESDWSYYFDYWGQGTMVTVSS

SEQ ID NO: 3160 - protein, 107 aa, Artificial Sequence
  Description of Artificial Sequence: Synthetic polypeptide
EIVLTQSPATLSLSPGERATLSCRASQSVSSYLAWYQQKPGLAPRLLIYDASNRATGIPARFSGSGSGTDFTLTISSLEPVDFAVYYCQQRSSWPWTFGQGTKVDIK

SEQ ID NO: 3161 - protein, 450 aa, Artificial Sequence
  Description of Artificial Sequence: Synthetic polypeptide
QVTLRESGPTLVKPTQTLTLTCTFSGFSLSTYGVGVGWIRQPPGKALEWLALIYWNDDKRYNPSLKSRLTITKDTSKNQVVLTMTNMDPVGTATYYCSHESDWSYYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3162 - protein, 214 aa, Artificial Sequence
  Description of Artificial Sequence: Synthetic polypeptide
EIVLTQSPATLSLSPGERATLSCRASQSVSSYLAWYQQKPGLAPRLLIYDASNRATGIPARFSGSGSGTDFTLTISSLEPVDFAVYYCQQRSSWPWTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3163 - protein, 5 aa, Artificial Sequence
  Description of Artificial Sequence: Synthetic peptide
SYVIS

SEQ ID NO: 3164 - protein, 17 aa, Artificial Sequence
  Description of Artificial Sequence: Synthetic peptide
GILPILSTANYAQKFQG

SEQ ID NO: 3165 - protein, 10 aa, Artificial Sequence
  Description of Artificial Sequence: Synthetic peptide
AHDYYYGMDV

SEQ ID NO: 3166 - protein, 16 aa, Artificial Sequence
  Description of Artificial Sequence: Synthetic peptide
RSSQSLVHSDGNTYLS

SEQ ID NO: 3167 - protein, 7 aa, Artificial Sequence
  Description of Artificial Sequence: Synthetic peptide
KISNRFS

SEQ ID NO: 3168 - protein, 9 aa, Artificial Sequence
  Description of Artificial Sequence: Synthetic peptide
MQATHHPLT

SEQ ID NO: 3169 - protein, 7 aa, Artificial Sequence
  Description of Artificial Sequence: Synthetic peptide
GGTFSSY

SEQ ID NO: 3170 - protein, 6 aa, Artificial Sequence
  Description of Artificial Sequence: Synthetic peptide
LPILST

SEQ ID NO: 3171 - protein, 9 aa, Artificial Sequence
  Description of Artificial Sequence: Synthetic peptide
AHDYYYGMD

SEQ ID NO: 3172 - protein, 12 aa, Artificial Sequence
  Description of Artificial Sequence: Synthetic peptide
SQSLVHSDGNTY

SEQ ID NO: 3173 - protein, 3 aa, Artificial Sequence
  Description of Artificial Sequence: Synthetic peptide
KIS

SEQ ID NO: 3174 - protein, 6 aa, Artificial Sequence
  Description of Artificial Sequence: Synthetic peptide
ATHHPL

SEQ ID NO: 3175 - protein, 10 aa, Artificial Sequence
  Description of Artificial Sequence: Synthetic peptide
GGTFSSYVIS

SEQ ID NO: 3176 - protein, 10 aa, Artificial Sequence
  Description of Artificial Sequence: Synthetic peptide
GILPILSTAN

SEQ ID NO: 3177 - protein, 10 aa, Artificial Sequence
  Description of Artificial Sequence: Synthetic peptide
AHDYYYGMDV

SEQ ID NO: 3178 - protein, 16 aa, Artificial Sequence
  Description of Artificial Sequence: Synthetic peptide
RSSQSLVHSDGNTYLS

SEQ ID NO: 3179 - protein, 7 aa, Artificial Sequence
  Description of Artificial Sequence: Synthetic peptide
KISNRFS

SEQ ID NO: 3180 - protein, 9 aa, Artificial Sequence
  Description of Artificial Sequence: Synthetic peptide
MQATHHPLT

SEQ ID NO: 3181 - protein, 6 aa, Artificial Sequence
  Description of Artificial Sequence: Synthetic peptide
SSYVIS

SEQ ID NO: 3182 - protein, 13 aa, Artificial Sequence
  Description of Artificial Sequence: Synthetic peptide
WMGGILPILSTAN

SEQ ID NO: 3183 - protein, 11 aa, Artificial Sequence
  Description of Artificial Sequence: Synthetic peptide
ARAHDYYYGMD

SEQ ID NO: 3184 - protein, 12 aa, Artificial Sequence
  Description of Artificial Sequence: Synthetic peptide
VHSDGNTYLSWL

SEQ ID NO: 3185 - protein, 10 aa, Artificial Sequence
  Description of Artificial Sequence: Synthetic peptide
LLVYKISNRF

SEQ ID NO: 3186 - protein, 8 aa, Artificial Sequence
  Description of Artificial Sequence: Synthetic peptide
MQATHHPL

SEQ ID NO: 3187 - protein, 8 aa, Artificial Sequence
  Description of Artificial Sequence: Synthetic peptide
GGTFSSYV

SEQ ID NO: 3188 - protein, 8 aa, Artificial Sequence
  Description of Artificial Sequence: Synthetic peptide
ILPILSTA

SEQ ID NO: 3189 - protein, 12 aa, Artificial Sequence
  Description of Artificial Sequence: Synthetic peptide
ARAHDYYYGMDV

SEQ ID NO: 3190 - protein, 11 aa, Artificial Sequence
  Description of Artificial Sequence: Synthetic peptide
QSLVHSDGNTY

SEQ ID NO: 3191 - protein, 3 aa, Artificial Sequence
  Description of Artificial Sequence: Synthetic peptide
KIS

SEQ ID NO: 3192 - protein, 9 aa, Artificial Sequence
  Description of Artificial Sequence: Synthetic peptide
MQATHHPLT

SEQ ID NO: 3193 - protein, 119 aa, Artificial Sequence
  Description of Artificial Sequence: Synthetic polypeptide
EVQLVQSGAEVKKPGSSVKVSCKASGGTFSSYVISWVRQAPGQGLEWMGGILPILSTANYAQKFQGRVTITADKSTSTAYMELSSLRSEDTAVYYCARAHDYYYGMDVWGQGTMVTVSS

SEQ ID NO: 3194 - protein, 112 aa, Artificial Sequence
  Description of Artificial Sequence: Synthetic polypeptide
DIVMTQTPLSSPVTLGQPASISCRSSQSLVHSDGNTYLSWLQQRPGQPPRLLVYKISNRFSGVPDRFSGSGAGTDFTLKISRVEAEDVGIYYCMQATHHPLTFGGGTKLEIK

SEQ ID NO: 3195 - protein, 449 aa, Artificial Sequence
  Description of Artificial Sequence: Synthetic polypeptide
EVQLVQSGAEVKKPGSSVKVSCKASGGTFSSYVISWVRQAPGQGLEWMGGILPILSTANYAQKFQGRVTITADKSTSTAYMELSSLRSEDTAVYYCARAHDYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3196 - protein, 219 aa, Artificial Sequence
  Description of Artificial Sequence: Synthetic polypeptide
DIVMTQTPLSSPVTLGQPASISCRSSQSLVHSDGNTYLSWLQQRPGQPPRLLVYKISNRFSGVPDRFSGSGAGTDFTLKISRVEAEDVGIYYCMQATHHPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3197 - protein, 5 aa, Artificial Sequence
  Description of Artificial Sequence: Synthetic peptide
NYYWS

SEQ ID NO: 3198 - protein, 16 aa, Artificial Sequence
  Description of Artificial Sequence: Synthetic peptide
RIYSSGITNYNPSLKS

SEQ ID NO: 3199 - protein, 10 aa, Artificial Sequence
  Description of Artificial Sequence: Synthetic peptide
IVGVKGAFAI

SEQ ID NO: 3200 - protein, 14 aa, Artificial Sequence
  Description of Artificial Sequence: Synthetic peptide
TGTSSDVGGYNYVS

SEQ ID NO: 3201 - protein, 7 aa, Artificial Sequence
  Description of Artificial Sequence: Synthetic peptide
EVSNRPS

SEQ ID NO: 3202 - protein, 9 aa, Artificial Sequence
  Description of Artificial Sequence: Synthetic peptide
SSYTSTSVV

SEQ ID NO: 3203 - protein, 7 aa, Artificial Sequence
  Description of Artificial Sequence: Synthetic peptide
GGSISNY

SEQ ID NO: 3204 - protein, 5 aa, Artificial Sequence
  Description of Artificial Sequence: Synthetic peptide
YSSGI

SEQ ID NO: 3205 - protein, 9 aa, Artificial Sequence
  Description of Artificial Sequence: Synthetic peptide
IVGVKGAFA

SEQ ID NO: 3206 - protein, 10 aa, Artificial Sequence
  Description of Artificial Sequence: Synthetic peptide
TSSDVGGYNY

SEQ ID NO: 3207 - protein, 3 aa, Artificial Sequence
  Description of Artificial Sequence: Synthetic peptide
EVS

SEQ ID NO: 3208 - protein, 6 aa, Artificial Sequence
  Description of Artificial Sequence: Synthetic peptide
YTSTSV

SEQ ID NO: 3209 - protein, 10 aa, Artificial Sequence
  Description of Artificial Sequence: Synthetic peptide
GGSISNYYWS

SEQ ID NO: 3210 - protein, 9 aa, Artificial Sequence
  Description of Artificial Sequence: Synthetic peptide
RIYSSGITN

SEQ ID NO: 3211 - protein, 10 aa, Artificial Sequence
  Description of Artificial Sequence: Synthetic peptide
IVGVKGAFAI

SEQ ID NO: 3212 - protein, 14 aa, Artificial Sequence
  Description of Artificial Sequence: Synthetic peptide
TGTSSDVGGYNYVS

SEQ ID NO: 3213 - protein, 7 aa, Artificial Sequence
  Description of Artificial Sequence: Synthetic peptide
EVSNRPS

SEQ ID NO: 3214 - protein, 9 aa, Artificial Sequence
  Description of Artificial Sequence: Synthetic peptide
SSYTSTSVV

SEQ ID NO: 3215 - protein, 6 aa, Artificial Sequence
  Description of Artificial Sequence: Synthetic peptide
SNYYWS

SEQ ID NO: 3216 - protein, 12 aa, Artificial Sequence
  Description of Artificial Sequence: Synthetic peptide
WIGRIYSSGITN

SEQ ID NO: 3217 - protein, 11 aa, Artificial Sequence
  Description of Artificial Sequence: Synthetic peptide
AGIVGVKGAFA

SEQ ID NO: 3218 - protein, 10 aa, Artificial Sequence
  Description of Artificial Sequence: Synthetic peptide
VGGYNYVSWY

SEQ ID NO: 3219 - protein, 10 aa, Artificial Sequence
  Description of Artificial Sequence: Synthetic peptide
LMIYEVSNRP

SEQ ID NO: 3220 - protein, 8 aa, Artificial Sequence
  Description of Artificial Sequence: Synthetic peptide
SSYTSTSV

SEQ ID NO: 3221 - protein, 8 aa, Artificial Sequence
  Description of Artificial Sequence: Synthetic peptide
GGSISNYY

SEQ ID NO: 3222 - protein, 7 aa, Artificial Sequence
  Description of Artificial Sequence: Synthetic peptide
IYSSGIT

SEQ ID NO: 3223 - protein, 12 aa, Artificial Sequence
  Description of Artificial Sequence: Synthetic peptide
AGIVGVKGAFAI

SEQ ID NO: 3224 - protein, 9 aa, Artificial Sequence
  Description of Artificial Sequence: Synthetic peptide
SSDVGGYNY

SEQ ID NO: 3225 - protein, 3 aa, Artificial Sequence
  Description of Artificial Sequence: Synthetic peptide
EVS

SEQ ID NO: 3226 - protein, 9 aa, Artificial Sequence
  Description of Artificial Sequence: Synthetic peptide
SSYTSTSVV

SEQ ID NO: 3227 - protein, 118 aa, Artificial Sequence
  Description of Artificial Sequence: Synthetic polypeptide
QVQLVQSGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTMVTVSS

SEQ ID NO: 3228 - protein, 109 aa, Artificial Sequence; identical to SEQ ID NO: 3058
  Description of Artificial Sequence: Synthetic polypeptide

SEQ ID NO: 3229 - protein, 448 aa, Artificial Sequence
  Description of Artificial Sequence: Synthetic polypeptide
QVQLVQSGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3230 - protein, 215 aa, Artificial Sequence; identical to SEQ ID NO: 3060
  Description of Artificial Sequence: Synthetic polypeptide

SEQ ID NO: 3231 - protein, 5 aa, Artificial Sequence
  Description of Artificial Sequence: Synthetic peptide
SYDMN

SEQ ID NO: 3232 - protein, 17 aa, Artificial Sequence
  Description of Artificial Sequence: Synthetic peptide
YISSSSTAKYYADSVKG

SEQ ID NO: 3233 - protein, 12 aa, Artificial Sequence
  Description of Artificial Sequence: Synthetic peptide
EDIVVVTPILQH

SEQ ID NO: 3234 - protein, 11 aa, Artificial Sequence
  Description of Artificial Sequence: Synthetic peptide
RASQSVSNYLA

SEQ ID NO: 3235 - protein, 7 aa, Artificial Sequence
  Description of Artificial Sequence: Synthetic peptide
DASNRAT

SEQ ID NO: 3236 - protein, 7 aa, Artificial Sequence
  Description of Artificial Sequence: Synthetic peptide
QQRSNWT

SEQ ID NO: 3237 - protein, 7 aa, Artificial Sequence
  Description of Artificial Sequence: Synthetic peptide
GFTFSSY

SEQ ID NO: 3238 - protein, 6 aa, Artificial Sequence
  Description of Artificial Sequence: Synthetic peptide
SSSSTA

SEQ ID NO: 3239 - protein, 11 aa, Artificial Sequence
  Description of Artificial Sequence: Synthetic peptide
EDIVVVTPILQ

SEQ ID NO: 3240 - protein, 7 aa, Artificial Sequence
  Description of Artificial Sequence: Synthetic peptide
SQSVSNY

SEQ ID NO: 3241 - protein, 3 aa, Artificial Sequence
  Description of Artificial Sequence: Synthetic peptide
DAS

SEQ ID NO: 3242 - protein, 4 aa, Artificial Sequence
  Description of Artificial Sequence: Synthetic peptide
RSNW

SEQ ID NO: 3243 - protein, 10 aa, Artificial Sequence
  Description of Artificial Sequence: Synthetic peptide
GFTFSSYDMN

SEQ ID NO: 3244 - protein, 10 aa, Artificial Sequence
  Description of Artificial Sequence: Synthetic peptide
YISSSSTAKY

SEQ ID NO: 3245 - protein, 12 aa, Artificial Sequence
  Description of Artificial Sequence: Synthetic peptide
EDIVVVTPILQH

SEQ ID NO: 3246 - protein, 11 aa, Artificial Sequence
  Description of Artificial Sequence: Synthetic peptide
RASQSVSNYLA

SEQ ID NO: 3247 - protein, 7 aa, Artificial Sequence
  Description of Artificial Sequence: Synthetic peptide
DASNRAT

SEQ ID NO: 3248 - protein, 7 aa, Artificial Sequence
  Description of Artificial Sequence: Synthetic peptide
QQRSNWT

SEQ ID NO: 3249 - protein, 6 aa, Artificial Sequence
  Description of Artificial Sequence: Synthetic peptide
SSYDMN

SEQ ID NO: 3250 - protein, 13 aa, Artificial Sequence
  Description of Artificial Sequence: Synthetic peptide
WVSYISSSSTAKY

SEQ ID NO: 3251 - protein, 13 aa, Artificial Sequence
  Description of Artificial Sequence: Synthetic peptide
AREDIVVVTPILQ

SEQ ID NO: 3252 - protein, 7 aa, Artificial Sequence
  Description of Artificial Sequence: Synthetic peptide
SNYLAWY

SEQ ID NO: 3253 - protein, 10 aa, Artificial Sequence
  Description of Artificial Sequence: Synthetic peptide
LLIYDASNRA

SEQ ID NO: 3254 - protein, 6 aa, Artificial Sequence
  Description of Artificial Sequence: Synthetic peptide
QQRSNW

SEQ ID NO: 3255 - protein, 8 aa, Artificial Sequence
  Description of Artificial Sequence: Synthetic peptide
GFTFSSYD

SEQ ID NO: 3256 - protein, 8 aa, Artificial Sequence
  Description of Artificial Sequence: Synthetic peptide
ISSSSTAK

SEQ ID NO: 3257 - protein, 14 aa, Artificial Sequence
  Description of Artificial Sequence: Synthetic peptide
AREDIVVVTPILQH

SEQ ID NO: 3258 - protein, 6 aa, Artificial Sequence
  Description of Artificial Sequence: Synthetic peptide
QSVSNY

SEQ ID NO: 3259 - protein, 3 aa, Artificial Sequence
  Description of Artificial Sequence: Synthetic peptide
DAS

SEQ ID NO: 3260 - protein, 7 aa, Artificial Sequence
  Description of Artificial Sequence: Synthetic peptide
QQRSNWT

SEQ ID NO: 3261 - protein, 121 aa, Artificial Sequence
  Description of Artificial Sequence: Synthetic polypeptide
QVQLVQSGGTLVQPGGSLRLSCAVSGFTFSSYDMNWVRQAPGKGLEWVSYISSSSTAKYYADSVKGRFTISRDNAKNSLYLQMNSLWDEDTAVYYCAREDIVVVTPILQHWGQGTLVTVSS

SEQ ID NO: 3262 - protein, 105 aa, Artificial Sequence
  Description of Artificial Sequence: Synthetic polypeptide
EIVMTQSPATLSLSPGERATLSCRASQSVSNYLAWYQQKSGQAPRLLIYDASNRATGIPARFSGSGSGTDFTLTISSLEPEDFAVYCCQQRSNWTFGQGTRLEIK

SEQ ID NO: 3263 - protein, 451 aa, Artificial Sequence
  Description of Artificial Sequence: Synthetic polypeptide
QVQLVQSGGTLVQPGGSLRLSCAVSGFTFSSYDMNWVRQAPGKGLEWVSYISSSSTAKYYADSVKGRFTISRDNAKNSLYLQMNSLWDEDTAVYYCAREDIVVVTPILQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3264 - protein, 212 aa, Artificial Sequence
  Description of Artificial Sequence: Synthetic polypeptide
EIVMTQSPATLSLSPGERATLSCRASQSVSNYLAWYQQKSGQAPRLLIYDASNRATGIPARFSGSGSGTDFTLTISSLEPEDFAVYCCQQRSNWTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3265 - protein, 5 aa, Artificial Sequence
  Description of Artificial Sequence: Synthetic peptide
NHGMS

SEQ ID NO: 3266 - protein, 17 aa, Artificial Sequence
  Description of Artificial Sequence: Synthetic peptide
SITRGGDTTYYPDNVKG

SEQ ID NO: 3267 - protein, 11 aa, Artificial Sequence
  Description of Artificial Sequence: Synthetic peptide
GPLTVGYAMDY

SEQ ID NO: 3268 - protein, 13 aa, Artificial Sequence
  Description of Artificial Sequence: Synthetic peptide
SGNSSNIGHNYVS

SEQ ID NO: 3269 - protein, 7 aa, Artificial Sequence
  Description of Artificial Sequence: Synthetic peptide
DNNQRPS

SEQ ID NO: 3270 - protein, 11 aa, Artificial Sequence
  Description of Artificial Sequence: Synthetic peptide
GIWDSSLSIVV

SEQ ID NO: 3271 - protein, 7 aa, Artificial Sequence
  Description of Artificial Sequence: Synthetic peptide
GFTFSNH

SEQ ID NO: 3272 - protein, 6 aa, Artificial Sequence
  Description of Artificial Sequence: Synthetic peptide
TRGGDT

SEQ ID NO: 3273 - protein, 10 aa, Artificial Sequence
  Description of Artificial Sequence: Synthetic peptide
GPLTVGYAMD

SEQ ID NO: 3274 - protein, 9 aa, Artificial Sequence
  Description of Artificial Sequence: Synthetic peptide
NSSNIGHNY

SEQ ID NO: 3275 - protein, 3 aa, Artificial Sequence
  Description of Artificial Sequence: Synthetic peptide
DNN

SEQ ID NO: 3276 - protein, 8 aa, Artificial Sequence
  Description of Artificial Sequence: Synthetic peptide
WDSSLSIV

SEQ ID NO: 3277 - protein, 10 aa, Artificial Sequence
  Description of Artificial Sequence: Synthetic peptide
GFTFSNHGMS

SEQ ID NO: 3278 - protein, 10 aa, Artificial Sequence
  Description of Artificial Sequence: Synthetic peptide
SITRGGDTTY

SEQ ID NO: 3279 - protein, 11 aa, Artificial Sequence
  Description of Artificial Sequence: Synthetic peptide
GPLTVGYAMDY

SEQ ID NO: 3280 - protein, 13 aa, Artificial Sequence
  Description of Artificial Sequence: Synthetic peptide
SGNSSNIGHNYVS

SEQ ID NO: 3281 - protein, 7 aa, Artificial Sequence
  Description of Artificial Sequence: Synthetic peptide
DNNQRPS

SEQ ID NO: 3282 - protein, 11 aa, Artificial Sequence
  Description of Artificial Sequence: Synthetic peptide
GIWDSSLSIVV

SEQ ID NO: 3283 - protein, 6 aa, Artificial Sequence
  Description of Artificial Sequence: Synthetic peptide
SNHGMS

SEQ ID NO: 3284 - protein, 13 aa, Artificial Sequence
  Description of Artificial Sequence: Synthetic peptide
WVASITRGGDTTY

SEQ ID NO: 3285 - protein, 12 aa, Artificial Sequence
  Description of Artificial Sequence: Synthetic peptide
TRGPLTVGYAMD

SEQ ID NO: 3286 - protein, 9 aa, Artificial Sequence
  Description of Artificial Sequence: Synthetic peptide
IGHNYVSWY

SEQ ID NO: 3287 - protein, 10 aa, Artificial Sequence
  Description of Artificial Sequence: Synthetic peptide
LLIYDNNQRP

SEQ ID NO: 3288 - protein, 10 aa, Artificial Sequence
  Description of Artificial Sequence: Synthetic peptide
GIWDSSLSIV

SEQ ID NO: 3289 - protein, 8 aa, Artificial Sequence
  Description of Artificial Sequence: Synthetic peptide
GFTFSNHG

SEQ ID NO: 3290 - protein, 8 aa, Artificial Sequence
  Description of Artificial Sequence: Synthetic peptide
ITRGGDTT

SEQ ID NO: 3291 - protein, 13 aa, Artificial Sequence
  Description of Artificial Sequence: Synthetic peptide
TRGPLTVGYAMDY

SEQ ID NO: 3292 - protein, 8 aa, Artificial Sequence
  Description of Artificial Sequence: Synthetic peptide
SSNIGHNY

SEQ ID NO: 3293 - protein, 3 aa, Artificial Sequence
  Description of Artificial Sequence: Synthetic peptide
DNN

SEQ ID NO: 3294 - protein, 11 aa, Artificial Sequence
  Description of Artificial Sequence: Synthetic peptide
GIWDSSLSIVV

SEQ ID NO: 3295 - protein, 120 aa, Artificial Sequence
  Description of Artificial Sequence: Synthetic polypeptide
QVQLVQSGGGLVKPGASLKLSCAASGFTFSNHGMSWVRQTSDKRLEWVASITRGGDTTYYPDNVKGRFTISRENAKNTLYLQMSSLKSDDTALYYCTRGPLTVGYAMDYWGQGTTVTVSS

SEQ ID NO: 3296 - protein, 110 aa, Artificial Sequence
  Description of Artificial Sequence: Synthetic polypeptide
QLVLTQPPSVSAAPGQKVTISCSGNSSNIGHNYVSWYQQLPGTAPKLLIYDNNQRPSGIPDRFSGSKSDTSATLGITGLQTGDEADYYCGIWDSSLSIVVFGGGTKVTVL

SEQ ID NO: 3297 - protein, 450 aa, Artificial Sequence
  Description of Artificial Sequence: Synthetic polypeptide
QVQLVQSGGGLVKPGASLKLSCAASGFTFSNHGMSWVRQTSDKRLEWVASITRGGDTTYYPDNVKGRFTISRENAKNTLYLQMSSLKSDDTALYYCTRGPLTVGYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3298 - protein, 216 aa, Artificial Sequence
  Description of Artificial Sequence: Synthetic polypeptide
QLVLTQPPSVSAAPGQKVTISCSGNSSNIGHNYVSWYQQLPGTAPKLLIYDNNQRPSGIPDRFSGSKSDTSATLGITGLQTGDEADYYCGIWDSSLSIVVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3299 - protein, 5 aa, Artificial Sequence
  Description of Artificial Sequence: Synthetic peptide
NYYWS

SEQ ID NO: 3300 - protein, 16 aa, Artificial Sequence
  Description of Artificial Sequence: Synthetic peptide
RIYSSGITNYNPSLKS

SEQ ID NO: 3301 - protein, 10 aa, Artificial Sequence
  Description of Artificial Sequence: Synthetic peptide
IVGVKGAFAI

SEQ ID NO: 3302 - protein, 14 aa, Artificial Sequence
  Description of Artificial Sequence: Synthetic peptide
TGTSSDVGGYNYVS

SEQ ID NO: 3303 - protein, 7 aa, Artificial Sequence
  Description of Artificial Sequence: Synthetic peptide
EVSNRPS

SEQ ID NO: 3304 - protein, 9 aa, Artificial Sequence
  Description of Artificial Sequence: Synthetic peptide
SSYTSTSVV

SEQ ID NO: 3305 - protein, 7 aa, Artificial Sequence
  Description of Artificial Sequence: Synthetic peptide
GGSISNY

SEQ ID NO: 3306 - protein, 5 aa, Artificial Sequence
  Description of Artificial Sequence: Synthetic peptide
YSSGI

SEQ ID NO: 3307 - protein, 9 aa, Artificial Sequence
  Description of Artificial Sequence: Synthetic peptide
IVGVKGAFA

SEQ ID NO: 3308 - protein, 10 aa, Artificial Sequence
  Description of Artificial Sequence: Synthetic peptide
TSSDVGGYNY

SEQ ID NO: 3309 - protein, 3 aa, Artificial Sequence
  Description of Artificial Sequence: Synthetic peptide
EVS

SEQ ID NO: 3310 - protein, 6 aa, Artificial Sequence
  Description of Artificial Sequence: Synthetic peptide
YTSTSV

SEQ ID NO: 3311 - protein, 10 aa, Artificial Sequence
  Description of Artificial Sequence: Synthetic peptide
GGSISNYYWS

SEQ ID NO: 3312 - protein, 9 aa, Artificial Sequence
  Description of Artificial Sequence: Synthetic peptide
RIYSSGITN

SEQ ID NO: 3313 - protein, 10 aa, Artificial Sequence
  Description of Artificial Sequence: Synthetic peptide
IVGVKGAFAI

SEQ ID NO: 3314 - protein, 14 aa, Artificial Sequence
  Description of Artificial Sequence: Synthetic peptide
TGTSSDVGGYNYVS

SEQ ID NO: 3315 - protein, 7 aa, Artificial Sequence
  Description of Artificial Sequence: Synthetic peptide
EVSNRPS

SEQ ID NO: 3316 - protein, 9 aa, Artificial Sequence
  Description of Artificial Sequence: Synthetic peptide
SSYTSTSVV

SEQ ID NO: 3317 - protein, 6 aa, Artificial Sequence
  Description of Artificial Sequence: Synthetic peptide
SNYYWS

SEQ ID NO: 3318 - protein, 12 aa, Artificial Sequence
  Description of Artificial Sequence: Synthetic peptide
WIGRIYSSGITN

SEQ ID NO: 3319 - protein, 11 aa, Artificial Sequence
  Description of Artificial Sequence: Synthetic peptide
AGIVGVKGAFA

SEQ ID NO: 3320 - protein, 10 aa, Artificial Sequence
  Description of Artificial Sequence: Synthetic peptide
VGGYNYVSWY

SEQ ID NO: 3321 - protein, 10 aa, Artificial Sequence
  Description of Artificial Sequence: Synthetic peptide
LMIYEVSNRP

SEQ ID NO: 3322 - protein, 8 aa, Artificial Sequence
  Description of Artificial Sequence: Synthetic peptide
SSYTSTSV

SEQ ID NO: 3323 - protein, 8 aa, Artificial Sequence
  Description of Artificial Sequence: Synthetic peptide
GGSISNYY

SEQ ID NO: 3324 - protein, 7 aa, Artificial Sequence
  Description of Artificial Sequence: Synthetic peptide
IYSSGIT

SEQ ID NO: 3325 - protein, 12 aa, Artificial Sequence
  Description of Artificial Sequence: Synthetic peptide
AGIVGVKGAFAI

SEQ ID NO: 3326 - protein, 9 aa, Artificial Sequence
  Description of Artificial Sequence: Synthetic peptide
SSDVGGYNY

SEQ ID NO: 3327 - protein, 3 aa, Artificial Sequence
  Description of Artificial Sequence: Synthetic peptide
EVS

SEQ ID NO: 3328 - protein, 9 aa, Artificial Sequence
  Description of Artificial Sequence: Synthetic peptide
SSYTSTSVV

SEQ ID NO: 3329 - protein, 118 aa, Artificial Sequence
  Description of Artificial Sequence: Synthetic polypeptide
QVQLQESGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTMVTVSS

SEQ ID NO: 3330 - protein, 109 aa, Artificial Sequence
  Description of Artificial Sequence: Synthetic polypeptide
QAVLTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKLTVL

SEQ ID NO: 3331 - protein, 448 aa, Artificial Sequence
  Description of Artificial Sequence: Synthetic polypeptide
QVQLQESGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3332 - protein, 215 aa, Artificial Sequence
  Description of Artificial Sequence: Synthetic polypeptide
QAVLTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3333 - protein, 5 aa, Artificial Sequence
  Description of Artificial Sequence: Synthetic peptide
NYYWS

SEQ ID NO: 3334 - protein, 16 aa, Artificial Sequence
  Description of Artificial Sequence: Synthetic peptide
RIYSSGITNYNPSLKS

SEQ ID NO: 3335 - protein, 10 aa, Artificial Sequence
  Description of Artificial Sequence: Synthetic peptide
IVGVKGAFAI

SEQ ID NO: 3336 - protein, 14 aa, Artificial Sequence
  Description of Artificial Sequence: Synthetic peptide
TGTSSDVGGYNYVS

SEQ ID NO: 3337 - protein, 7 aa, Artificial Sequence
  Description of Artificial Sequence: Synthetic peptide
EVSNRPS

SEQ ID NO: 3338 - protein, 9 aa, Artificial Sequence
  Description of Artificial Sequence: Synthetic peptide
SSYTSTSVV

SEQ ID NO: 3339 - protein, 7 aa, Artificial Sequence
  Description of Artificial Sequence: Synthetic peptide
GGSISNY

SEQ ID NO: 3340 - protein, 5 aa, Artificial Sequence
  Description of Artificial Sequence: Synthetic peptide
YSSGI

SEQ ID NO: 3341 - protein, 9 aa, Artificial Sequence
  Description of Artificial Sequence: Synthetic peptide
IVGVKGAFA

SEQ ID NO: 3342 - protein, 10 aa, Artificial Sequence
  Description of Artificial Sequence: Synthetic peptide
TSSDVGGYNY

SEQ ID NO: 3343 - protein, 3 aa, Artificial Sequence
  Description of Artificial Sequence: Synthetic peptide
EVS

SEQ ID NO: 3344 - protein, 6 aa, Artificial Sequence
  Description of Artificial Sequence: Synthetic peptide
YTSTSV

SEQ ID NO: 3345 - protein, 10 aa, Artificial Sequence
  Description of Artificial Sequence: Synthetic peptide
GGSISNYYWS

SEQ ID NO: 3346 - protein, 9 aa, Artificial Sequence
  Description of Artificial Sequence: Synthetic peptide
RIYSSGITN

SEQ ID NO: 3347 - protein, 10 aa, Artificial Sequence
  Description of Artificial Sequence: Synthetic peptide
IVGVKGAFAI

SEQ ID NO: 3348 - protein, 14 aa, Artificial Sequence
  Description of Artificial Sequence: Synthetic peptide
TGTSSDVGGYNYVS

SEQ ID NO: 3349 - protein, 7 aa, Artificial Sequence
  Description of Artificial Sequence: Synthetic peptide
EVSNRPS

SEQ ID NO: 3350 - protein, 9 aa, Artificial Sequence
  Description of Artificial Sequence: Synthetic peptide
SSYTSTSVV

SEQ ID NO: 3351 - protein, 6 aa, Artificial Sequence
  Description of Artificial Sequence: Synthetic peptide
SNYYWS

SEQ ID NO: 3352 - protein, 12 aa, Artificial Sequence
  Description of Artificial Sequence: Synthetic peptide
WIGRIYSSGITN

SEQ ID NO: 3353 - protein, 11 aa, Artificial Sequence
  Description of Artificial Sequence: Synthetic peptide
AGIVGVKGAFA

SEQ ID NO: 3354 - protein, 10 aa, Artificial Sequence
  Description of Artificial Sequence: Synthetic peptide
VGGYNYVSWY

SEQ ID NO: 3355 - protein, 10 aa, Artificial Sequence
  Description of Artificial Sequence: Synthetic peptide
LMIYEVSNRP

SEQ ID NO: 3356 - protein, 8 aa, Artificial Sequence
  Description of Artificial Sequence: Synthetic peptide
SSYTSTSV

SEQ ID NO: 3357 - protein, 8 aa, Artificial Sequence
  Description of Artificial Sequence: Synthetic peptide
GGSISNYY

SEQ ID NO: 3358 - protein, 7 aa, Artificial Sequence
  Description of Artificial Sequence: Synthetic peptide
IYSSGIT

SEQ ID NO: 3359 - protein, 12 aa, Artificial Sequence
  Description of Artificial Sequence: Synthetic peptide
AGIVGVKGAFAI

SEQ ID NO: 3360 - protein, 9 aa, Artificial Sequence
  Description of Artificial Sequence: Synthetic peptide
SSDVGGYNY

SEQ ID NO: 3361 - protein, 3 aa, Artificial Sequence
  Description of Artificial Sequence: Synthetic peptide
EVS

SEQ ID NO: 3362 - protein, 9 aa, Artificial Sequence
  Description of Artificial Sequence: Synthetic peptide
SSYTSTSVV

SEQ ID NO: 3363 - protein, 118 aa, Artificial Sequence; identical to SEQ ID NO: 3057
  Description of Artificial Sequence: Synthetic polypeptide

SEQ ID NO: 3364 - protein, 109 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKLTVL

SEQ ID NO: 3365 - protein, 448 aa, Artificial Sequence; identical to SEQ ID NO: 3059
  Description of Artificial Sequence: Synthetic polypeptide

SEQ ID NO: 3366 - protein, 215 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3367 - protein, 5 aa, Artificial Sequence
  Description of Artificial Sequence: Synthetic peptide
TYAIS

SEQ ID NO: 3368 - protein, 17 aa, Artificial Sequence
  Description of Artificial Sequence: Synthetic peptide
GIIPIFGTATYAQRFQD

SEQ ID NO: 3369 - protein, 14 aa, Artificial Sequence
  Description of Artificial Sequence: Synthetic peptide
GVGWGSDYYYGLDV

SEQ ID NO: 3370 - protein, 16 aa, Artificial Sequence
  Description of Artificial Sequence: Synthetic peptide
RSSQSLVHSDGNTYLS

SEQ ID NO: 3371 - protein, 7 aa, Artificial Sequence
  Description of Artificial Sequence: Synthetic peptide
KISNRFS

SEQ ID NO: 3372 - protein, 9 aa, Artificial Sequence
  Description of Artificial Sequence: Synthetic peptide
IQATHHPLT

SEQ ID NO: 3373 - protein, 7 aa, Artificial Sequence
  Description of Artificial Sequence: Synthetic peptide
GGTFSTY

SEQ ID NO: 3374 - protein, 6 aa, Artificial Sequence
  Description of Artificial Sequence: Synthetic peptide
IPIFGT

SEQ ID NO: 3375 - protein, 13 aa, Artificial Sequence
  Description of Artificial Sequence: Synthetic peptide
GVGWGSDYYYGLD

SEQ ID NO: 3376 - protein, 12 aa, Artificial Sequence
  Description of Artificial Sequence: Synthetic peptide
SQSLVHSDGNTY

SEQ ID NO: 3377 - protein, 3 aa, Artificial Sequence
  Description of Artificial Sequence: Synthetic peptide
KIS

SEQ ID NO: 3378 - protein, 6 aa, Artificial Sequence
  Description of Artificial Sequence: Synthetic peptide
ATHHPL

SEQ ID NO: 3379 - protein, 10 aa, Artificial Sequence
  Description of Artificial Sequence: Synthetic peptide
GGTFSTYAIS

SEQ ID NO: 3380 - protein, 10 aa, Artificial Sequence
  Description of Artificial Sequence: Synthetic peptide
GIIPIFGTAT

SEQ ID NO: 3381 - protein, 14 aa, Artificial Sequence
  Description of Artificial Sequence: Synthetic peptide
GVGWGSDYYYGLDV

SEQ ID NO: 3382 - protein, 16 aa, Artificial Sequence
  Description of Artificial Sequence: Synthetic peptide
RSSQSLVHSDGNTYLS

SEQ ID NO: 3383 - protein, 7 aa, Artificial Sequence
  Description of Artificial Sequence: Synthetic peptide
KISNRFS

SEQ ID NO: 3384 - protein, 9 aa, Artificial Sequence
  Description of Artificial Sequence: Synthetic peptide
IQATHHPLT

SEQ ID NO: 3385 - protein, 6 aa, Artificial Sequence
  Description of Artificial Sequence: Synthetic peptide
STYAIS

SEQ ID NO: 3386 - protein, 13 aa, Artificial Sequence
  Description of Artificial Sequence: Synthetic peptide
WMGGIIPIFGTAT

SEQ ID NO: 3387 - protein, 15 aa, Artificial Sequence
  Description of Artificial Sequence: Synthetic peptide
ARGVGWGSDYYYGLD

SEQ ID NO: 3388 - protein, 12 aa, Artificial Sequence
  Description of Artificial Sequence: Synthetic peptide
VHSDGNTYLSWL

SEQ ID NO: 3389 - protein, 10 aa, Artificial Sequence
  Description of Artificial Sequence: Synthetic peptide
LLIYKISNRF

SEQ ID NO: 3390 - protein, 8 aa, Artificial Sequence
  Description of Artificial Sequence: Synthetic peptide
IQATHHPL

SEQ ID NO: 3391 - protein, 8 aa, Artificial Sequence
  Description of Artificial Sequence: Synthetic peptide
GGTFSTYA

SEQ ID NO: 3392 - protein, 8 aa, Artificial Sequence
  Description of Artificial Sequence: Synthetic peptide
IIPIFGTA

SEQ ID NO: 3393 - protein, 16 aa, Artificial Sequence
  Description of Artificial Sequence: Synthetic peptide
ARGVGWGSDYYYGLDV

SEQ ID NO: 3394 - protein, 11 aa, Artificial Sequence
  Description of Artificial Sequence: Synthetic peptide
QSLVHSDGNTY

SEQ ID NO: 3395 - protein, 3 aa, Artificial Sequence
  Description of Artificial Sequence: Synthetic peptide
KIS

SEQ ID NO: 3396 - protein, 9 aa, Artificial Sequence
  Description of Artificial Sequence: Synthetic peptide
IQATHHPLT

SEQ ID NO: 3397 - protein, 123 aa, Artificial Sequence
  Description of Artificial Sequence: Synthetic polypeptide
EVQLVESGAEVKKPGSSVKVSCKASGGTFSTYAISWVRQAPGQGLEWMGGIIPIFGTATYAQRFQDRVMITADKSTTTAYMELSSLRSEDTAVFYCARGVGWGSDYYYGLDVWGQGTMVTVSS

SEQ ID NO: 3398 - protein, 112 aa, Artificial Sequence
  Description of Artificial Sequence: Synthetic polypeptide
EIVMTQSPLSSPVTLGQPASISCRSSQSLVHSDGNTYLSWLQQRPGQSPRLLIYKISNRFSGVPDRFSGSGAGTDFTLRITRVEPEDVGVYYCIQATHHPLTFGGGTRLEIK

SEQ ID NO: 3399 - protein, 453 aa, Artificial Sequence
  Description of Artificial Sequence: Synthetic polypeptide
EVQLVESGAEVKKPGSSVKVSCKASGGTFSTYAISWVRQAPGQGLEWMGGIIPIFGTATYAQRFQDRVMITADKSTTTAYMELSSLRSEDTAVFYCARGVGWGSDYYYGLDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3400 - protein, 219 aa, Artificial Sequence
  Description of Artificial Sequence: Synthetic polypeptide
EIVMTQSPLSSPVTLGQPASISCRSSQSLVHSDGNTYLSWLQQRPGQSPRLLIYKISNRFSGVPDRFSGSGAGTDFTLRITRVEPEDVGVYYCIQATHHPLTFGGGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3401 - protein, 5 aa, Artificial Sequence
  Description of Artificial Sequence: Synthetic peptide
NYYWS

SEQ ID NO: 3402 - protein, 16 aa, Artificial Sequence
  Description of Artificial Sequence: Synthetic peptide
RIYSSGITNYNPSLKS

SEQ ID NO: 3403 - protein, 10 aa, Artificial Sequence
  Description of Artificial Sequence: Synthetic peptide
IVGVKGAFAI

SEQ ID NO: 3404 - protein, 14 aa, Artificial Sequence
  Description of Artificial Sequence: Synthetic peptide
TGTSSDVGGYNYVS

SEQ ID NO: 3405 - protein, 7 aa, Artificial Sequence
  Description of Artificial Sequence: Synthetic peptide
EVSNRPS

SEQ ID NO: 3406 - protein, 9 aa, Artificial Sequence
  Description of Artificial Sequence: Synthetic peptide
SSYTSTSVV

SEQ ID NO: 3407 - protein, 7 aa, Artificial Sequence
  Description of Artificial Sequence: Synthetic peptide
GGSISNY

SEQ ID NO: 3408 - protein, 5 aa, Artificial Sequence
  Description of Artificial Sequence: Synthetic peptide
YSSGI

SEQ ID NO: 3409 - protein, 9 aa, Artificial Sequence
  Description of Artificial Sequence: Synthetic peptide
IVGVKGAFA

SEQ ID NO: 3410 - protein, 10 aa, Artificial Sequence
  Description of Artificial Sequence: Synthetic peptide
TSSDVGGYNY

SEQ ID NO: 3411 - protein, 3 aa, Artificial Sequence
  Description of Artificial Sequence: Synthetic peptide
EVS

SEQ ID NO: 3412 - protein, 6 aa, Artificial Sequence
  Description of Artificial Sequence: Synthetic peptide
YTSTSV

SEQ ID NO: 3413 - protein, 10 aa, Artificial Sequence
  Description of Artificial Sequence: Synthetic peptide
GGSISNYYWS

SEQ ID NO: 3414 - protein, 9 aa, Artificial Sequence
  Description of Artificial Sequence: Synthetic peptide
RIYSSGITN

SEQ ID NO: 3415 - protein, 10 aa, Artificial Sequence
  Description of Artificial Sequence: Synthetic peptide
IVGVKGAFAI

SEQ ID NO: 3416 - protein, 14 aa, Artificial Sequence
  Description of Artificial Sequence: Synthetic peptide
TGTSSDVGGYNYVS

SEQ ID NO: 3417 - protein, 7 aa, Artificial Sequence
  Description of Artificial Sequence: Synthetic peptide
EVSNRPS

SEQ ID NO: 3418 - protein, 9 aa, Artificial Sequence
  Description of Artificial Sequence: Synthetic peptide
SSYTSTSVV

SEQ ID NO: 3419 - protein, 6 aa, Artificial Sequence
  Description of Artificial Sequence: Synthetic peptide
SNYYWS

SEQ ID NO: 3420 - protein, 12 aa, Artificial Sequence
  Description of Artificial Sequence: Synthetic peptide
WIGRIYSSGITN

SEQ ID NO: 3421 - protein, 11 aa, Artificial Sequence
  Description of Artificial Sequence: Synthetic peptide
AGIVGVKGAFA

SEQ ID NO: 3422 - protein, 10 aa, Artificial Sequence
  Description of Artificial Sequence: Synthetic peptide
VGGYNYVSWY

SEQ ID NO: 3423 - protein, 10 aa, Artificial Sequence
  Description of Artificial Sequence: Synthetic peptide
LMIYEVSNRP

SEQ ID NO: 3424 - protein, 8 aa, Artificial Sequence
  Description of Artificial Sequence: Synthetic peptide
SSYTSTSV

SEQ ID NO: 3425 - protein, 8 aa, Artificial Sequence
  Description of Artificial Sequence: Synthetic peptide
GGSISNYY

SEQ ID NO: 3426 - protein, 7 aa, Artificial Sequence
  Description of Artificial Sequence: Synthetic peptide
IYSSGIT

SEQ ID NO: 3427 - protein, 12 aa, Artificial Sequence
  Description of Artificial Sequence: Synthetic peptide
AGIVGVKGAFAI

SEQ ID NO: 3428 - protein, 9 aa, Artificial Sequence
  Description of Artificial Sequence: Synthetic peptide
SSDVGGYNY

SEQ ID NO: 3429 - protein, 3 aa, Artificial Sequence
  Description of Artificial Sequence: Synthetic peptide
EVS

SEQ ID NO: 3430 - protein, 9 aa, Artificial Sequence
  Description of Artificial Sequence: Synthetic peptide
SSYTSTSVV

SEQ ID NO: 3431 - protein, 118 aa, Artificial Sequence; identical to SEQ ID NO: 3329
  Description of Artificial Sequence: Synthetic polypeptide

SEQ ID NO: 3432 - protein, 109 aa, Artificial Sequence
  Description of Artificial Sequence: Synthetic polypeptide
QAVLTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKVTVL

SEQ ID NO: 3433 - protein, 448 aa, Artificial Sequence; identical to SEQ ID NO: 3331
  Description of Artificial Sequence: Synthetic polypeptide

SEQ ID NO: 3434 - protein, 215 aa, Artificial Sequence
  Description of Artificial Sequence: Synthetic polypeptide
QAVLTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3435 - protein, 5 aa, Artificial Sequence
  Description of Artificial Sequence: Synthetic peptide
SFYWS

SEQ ID NO: 3436 - protein, 16 aa, Artificial Sequence
  Description of Artificial Sequence: Synthetic peptide
RIYTSGGTIYNPSLKS

SEQ ID NO: 3437 - protein, 7 aa, Artificial Sequence
  Description of Artificial Sequence: Synthetic peptide
WLRAFDY

SEQ ID NO: 3438 - protein, 11 aa, Artificial Sequence
  Description of Artificial Sequence: Synthetic peptide
SGDKLGDKYAC

SEQ ID NO: 3439 - protein, 7 aa, Artificial Sequence
  Description of Artificial Sequence: Synthetic peptide
QDSKRPS

SEQ ID NO: 3440 - protein, 9 aa, Artificial Sequence
  Description of Artificial Sequence: Synthetic peptide
QAWDSSTVV

SEQ ID NO: 3441 - protein, 7 aa, Artificial Sequence
  Description of Artificial Sequence: Synthetic peptide
YGSFSSF

SEQ ID NO: 3442 - protein, 5 aa, Artificial Sequence
  Description of Artificial Sequence: Synthetic peptide
YTSGG

SEQ ID NO: 3443 - protein, 6 aa, Artificial Sequence
  Description of Artificial Sequence: Synthetic peptide
WLRAFD

SEQ ID NO: 3444 - protein, 7 aa, Artificial Sequence
  Description of Artificial Sequence: Synthetic peptide
DKLGDKY

SEQ ID NO: 3445 - protein, 3 aa, Artificial Sequence
  Description of Artificial Sequence: Synthetic peptide
QDS

SEQ ID NO: 3446 - protein, 6 aa, Artificial Sequence
  Description of Artificial Sequence: Synthetic peptide
WDSSTV

SEQ ID NO: 3447 - protein, 10 aa, Artificial Sequence
  Description of Artificial Sequence: Synthetic peptide
YGSFSSFYWS

SEQ ID NO: 3448 - protein, 9 aa, Artificial Sequence
  Description of Artificial Sequence: Synthetic peptide
RIYTSGGTI

SEQ ID NO: 3449 - protein, 7 aa, Artificial Sequence
  Description of Artificial Sequence: Synthetic peptide
WLRAFDY

SEQ ID NO: 3450 - protein, 11 aa, Artificial Sequence
  Description of Artificial Sequence: Synthetic peptide
SGDKLGDKYAC

SEQ ID NO: 3451 - protein, 7 aa, Artificial Sequence
  Description of Artificial Sequence: Synthetic peptide
QDSKRPS

SEQ ID NO: 3452 - protein, 9 aa, Artificial Sequence
  Description of Artificial Sequence: Synthetic peptide
QAWDSSTVV

SEQ ID NO: 3453 - protein, 6 aa, Artificial Sequence
  Description of Artificial Sequence: Synthetic peptide
SSFYWS

SEQ ID NO: 3454 - protein, 12 aa, Artificial Sequence
  Description of Artificial Sequence: Synthetic peptide
WIGRIYTSGGTI

SEQ ID NO: 3455 - protein, 8 aa, Artificial Sequence
  Description of Artificial Sequence: Synthetic peptide
ARWLRAFD

SEQ ID NO: 3456 - protein, 7 aa, Artificial Sequence
  Description of Artificial Sequence: Synthetic peptide
DKYACWY

SEQ ID NO: 3457 - protein, 10 aa, Artificial Sequence
  Description of Artificial Sequence: Synthetic peptide
LVIYQDSKRP

SEQ ID NO: 3458 - protein, 8 aa, Artificial Sequence
  Description of Artificial Sequence: Synthetic peptide
QAWDSSTV

SEQ ID NO: 3459 - protein, 8 aa, Artificial Sequence
  Description of Artificial Sequence: Synthetic peptide
YGSFSSFY

SEQ ID NO: 3460 - protein, 7 aa, Artificial Sequence
  Description of Artificial Sequence: Synthetic peptide
IYTSGGT

SEQ ID NO: 3461 - protein, 9 aa, Artificial Sequence
  Description of Artificial Sequence: Synthetic peptide
ARWLRAFDY

SEQ ID NO: 3462 - protein, 6 aa, Artificial Sequence
  Description of Artificial Sequence: Synthetic peptide
KLGDKY

SEQ ID NO: 3463 - protein, 3 aa, Artificial Sequence
  Description of Artificial Sequence: Synthetic peptide
QDS

SEQ ID NO: 3464 - protein, 9 aa, Artificial Sequence
  Description of Artificial Sequence: Synthetic peptide
QAWDSSTVV

SEQ ID NO: 3465 - protein, 115 aa, Artificial Sequence
  Description of Artificial Sequence: Synthetic polypeptide
QVQLQESGPGLVKPSETLSLTCTVSYGSFSSFYWSWIRQPAGKGLEWIGRIYTSGGTIYNPSLKSRVTMSVDTSKNQFSLKLSSVTAADTAVYYCARWLRAFDYWGQGTLVTVSS

SEQ ID NO: 3466 - protein, 106 aa, Artificial Sequence; identical to SEQ ID NO: 2378
  Description of Artificial Sequence: Synthetic polypeptide

SEQ ID NO: 3467 - protein, 445 aa, Artificial Sequence
  Description of Artificial Sequence: Synthetic polypeptide
QVQLQESGPGLVKPSETLSLTCTVSYGSFSSFYWSWIRQPAGKGLEWIGRIYTSGGTIYNPSLKSRVTMSVDTSKNQFSLKLSSVTAADTAVYYCARWLRAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3468 - protein, 212 aa, Artificial Sequence; identical to SEQ ID NO: 2380
  Description of Artificial Sequence: Synthetic polypeptide

SEQ ID NO: 3469 - protein, 5 aa, Artificial Sequence
  Description of Artificial Sequence: Synthetic peptide
NYYWS

SEQ ID NO: 3470 - protein, 16 aa, Artificial Sequence
  Description of Artificial Sequence: Synthetic peptide
RIYSSGITNYNPSLKS

SEQ ID NO: 3471 - protein, 10 aa, Artificial Sequence
  Description of Artificial Sequence: Synthetic peptide
IVGVKGAFAI

SEQ ID NO: 3472 - protein, 14 aa, Artificial Sequence
  Description of Artificial Sequence: Synthetic peptide
TGTSSDVGGYNYVS

SEQ ID NO: 3473 - protein, 7 aa, Artificial Sequence
  Description of Artificial Sequence: Synthetic peptide
EVSNRPS

SEQ ID NO: 3474 - protein, 9 aa, Artificial Sequence
  Description of Artificial Sequence: Synthetic peptide
SSYTSTSVV

SEQ ID NO: 3475 - protein, 7 aa, Artificial Sequence
  Description of Artificial Sequence: Synthetic peptide
GGSISNY

SEQ ID NO: 3476 - protein, 5 aa, Artificial Sequence
  Description of Artificial Sequence: Synthetic peptide
YSSGI

SEQ ID NO: 3477 - protein, 9 aa, Artificial Sequence
  Description of Artificial Sequence: Synthetic peptide
IVGVKGAFA

SEQ ID NO: 3478 - protein, 10 aa, Artificial Sequence
  Description of Artificial Sequence: Synthetic peptide
TSSDVGGYNY

SEQ ID NO: 3479 - protein, 3 aa, Artificial Sequence
  Description of Artificial Sequence: Synthetic peptide
EVS

SEQ ID NO: 3480 - protein, 6 aa, Artificial Sequence
  Description of Artificial Sequence: Synthetic peptide
YTSTSV

SEQ ID NO: 3481 - protein, 10 aa, Artificial Sequence
  Description of Artificial Sequence: Synthetic peptide
GGSISNYYWS

SEQ ID NO: 3482 - protein, 9 aa, Artificial Sequence
  Description of Artificial Sequence: Synthetic peptide
RIYSSGITN

SEQ ID NO: 3483 - protein, 10 aa, Artificial Sequence
  Description of Artificial Sequence: Synthetic peptide
IVGVKGAFAI

SEQ ID NO: 3484 - protein, 14 aa, Artificial Sequence
  Description of Artificial Sequence: Synthetic peptide
TGTSSDVGGYNYVS

SEQ ID NO: 3485 - protein, 7 aa, Artificial Sequence
  Description of Artificial Sequence: Synthetic peptide
EVSNRPS

SEQ ID NO: 3486 - protein, 9 aa, Artificial Sequence
  Description of Artificial Sequence: Synthetic peptide
SSYTSTSVV

SEQ ID NO: 3487 - protein, 6 aa, Artificial Sequence
  Description of Artificial Sequence: Synthetic peptide
SNYYWS

SEQ ID NO: 3488 - protein, 12 aa, Artificial Sequence
  Description of Artificial Sequence: Synthetic peptide
WIGRIYSSGITN

SEQ ID NO: 3489 - protein, 11 aa, Artificial Sequence
  Description of Artificial Sequence: Synthetic peptide
AGIVGVKGAFA

SEQ ID NO: 3490 - protein, 10 aa, Artificial Sequence
  Description of Artificial Sequence: Synthetic peptide
VGGYNYVSWY

SEQ ID NO: 3491 - protein, 10 aa, Artificial Sequence
  Description of Artificial Sequence: Synthetic peptide
LMIYEVSNRP

SEQ ID NO: 3492 - protein, 8 aa, Artificial Sequence
  Description of Artificial Sequence: Synthetic peptide
SSYTSTSV

SEQ ID NO: 3493 - protein, 8 aa, Artificial Sequence
  Description of Artificial Sequence: Synthetic peptide
GGSISNYY

SEQ ID NO: 3494 - protein, 7 aa, Artificial Sequence
  Description of Artificial Sequence: Synthetic peptide
IYSSGIT

SEQ ID NO: 3495 - protein, 12 aa, Artificial Sequence
  Description of Artificial Sequence: Synthetic peptide
AGIVGVKGAFAI

SEQ ID NO: 3496 - protein, 9 aa, Artificial Sequence
  Description of Artificial Sequence: Synthetic peptide
SSDVGGYNY

SEQ ID NO: 3497 - protein, 3 aa, Artificial Sequence
  Description of Artificial Sequence: Synthetic peptide
EVS

SEQ ID NO: 3498 - protein, 9 aa, Artificial Sequence
  Description of Artificial Sequence: Synthetic peptide
SSYTSTSVV

SEQ ID NO: 3499 - protein, 118 aa, Artificial Sequence; identical to SEQ ID NO: 3329
  Description of Artificial Sequence: Synthetic polypeptide

SEQ ID NO: 3500 - protein, 109 aa, Artificial Sequence
  Description of Artificial Sequence: Synthetic polypeptide
QPVLTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKLTVL

SEQ ID NO: 3501 - protein, 448 aa, Artificial Sequence; identical to SEQ ID NO: 3331
  Description of Artificial Sequence: Synthetic polypeptide

SEQ ID NO: 3502 - protein, 215 aa, Artificial Sequence
  Description of Artificial Sequence: Synthetic polypeptide
QPVLTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3503 - protein, 5 aa, Artificial Sequence
  Description of Artificial Sequence: Synthetic peptide
NHGMS

SEQ ID NO: 3504 - protein, 17 aa, Artificial Sequence
  Description of Artificial Sequence: Synthetic peptide
SITRGGDTTYYPDNVKG

SEQ ID NO: 3505 - protein, 11 aa, Artificial Sequence
  Description of Artificial Sequence: Synthetic peptide
GPLTVGYAMDY

SEQ ID NO: 3506 - protein, 11 aa, Artificial Sequence
  Description of Artificial Sequence: Synthetic peptide
QGDSLRSYYAT

SEQ ID NO: 3507 - protein, 7 aa, Artificial Sequence
  Description of Artificial Sequence: Synthetic peptide
GENNRPS

SEQ ID NO: 3508 - protein, 11 aa, Artificial Sequence
  Description of Artificial Sequence: Synthetic peptide
NSRDTGDHHLV

SEQ ID NO: 3509 - protein, 7 aa, Artificial Sequence
  Description of Artificial Sequence: Synthetic peptide
GFTFSNH

SEQ ID NO: 3510 - protein, 6 aa, Artificial Sequence
  Description of Artificial Sequence: Synthetic peptide
TRGGDT

SEQ ID NO: 3511 - protein, 10 aa, Artificial Sequence
  Description of Artificial Sequence: Synthetic peptide
GPLTVGYAMD

SEQ ID NO: 3512 - protein, 7 aa, Artificial Sequence
  Description of Artificial Sequence: Synthetic peptide
DSLRSYY

SEQ ID NO: 3513 - protein, 3 aa, Artificial Sequence
  Description of Artificial Sequence: Synthetic peptide
GEN

SEQ ID NO: 3514 - protein, 8 aa, Artificial Sequence
  Description of Artificial Sequence: Synthetic peptide
RDTGDHHL

SEQ ID NO: 3515 - protein, 10 aa, Artificial Sequence
  Description of Artificial Sequence: Synthetic peptide
GFTFSNHGMS

SEQ ID NO: 3516 - protein, 10 aa, Artificial Sequence
  Description of Artificial Sequence: Synthetic peptide
SITRGGDTTY

SEQ ID NO: 3517 - protein, 11 aa, Artificial Sequence
  Description of Artificial Sequence: Synthetic peptide
GPLTVGYAMDY

SEQ ID NO: 3518 - protein, 11 aa, Artificial Sequence
  Description of Artificial Sequence: Synthetic peptide
QGDSLRSYYAT

SEQ ID NO: 3519 - protein, 7 aa, Artificial Sequence
  Description of Artificial Sequence: Synthetic peptide
GENNRPS

SEQ ID NO: 3520 - protein, 11 aa, Artificial Sequence
  Description of Artificial Sequence: Synthetic peptide
NSRDTGDHHLV

SEQ ID NO: 3521 - protein, 6 aa, Artificial Sequence
  Description of Artificial Sequence: Synthetic peptide
SNHGMS

SEQ ID NO: 3522 - protein, 13 aa, Artificial Sequence
  Description of Artificial Sequence: Synthetic peptide
WVASITRGGDTTY

SEQ ID NO: 3523 - protein, 12 aa, Artificial Sequence
  Description of Artificial Sequence: Synthetic peptide
TRGPLTVGYAMD

SEQ ID NO: 3524 - protein, 7 aa, Artificial Sequence
  Description of Artificial Sequence: Synthetic peptide
SYYATWY

SEQ ID NO: 3525 - protein, 10 aa, Artificial Sequence
  Description of Artificial Sequence: Synthetic peptide
LVIYGENNRP

SEQ ID NO: 3526 - protein, 10 aa, Artificial Sequence
  Description of Artificial Sequence: Synthetic peptide
NSRDTGDHHL

SEQ ID NO: 3527 - protein, 8 aa, Artificial Sequence
  Description of Artificial Sequence: Synthetic peptide
GFTFSNHG

SEQ ID NO: 3528 - protein, 8 aa, Artificial Sequence
  Description of Artificial Sequence: Synthetic peptide
ITRGGDTT

SEQ ID NO: 3529 - protein, 13 aa, Artificial Sequence
  Description of Artificial Sequence: Synthetic peptide
TRGPLTVGYAMDY

SEQ ID NO: 3530 - protein, 6 aa, Artificial Sequence
  Description of Artificial Sequence: Synthetic peptide
SLRSYY

SEQ ID NO: 3531 - protein, 3 aa, Artificial Sequence
  Description of Artificial Sequence: Synthetic peptide
GEN

SEQ ID NO: 3532 - protein, 11 aa, Artificial Sequence
  Description of Artificial Sequence: Synthetic peptide
NSRDTGDHHLV

SEQ ID NO: 3533 - protein, 120 aa, Artificial Sequence
  Description of Artificial Sequence: Synthetic polypeptide
EVQLLESGGGLVKPGASLKLSCAASGFTFSNHGMSWVRQTSDKRLEWVASITRGGDTTYYPDNVKGRFTISRENAKNTLYLQMSSLKSDDTALYYCTRGPLTVGYAMDYWGQGTTVTVSS

SEQ ID NO: 3534 - protein, 108 aa, Artificial Sequence; identical to SEQ ID NO: 2854
  Description of Artificial Sequence: Synthetic polypeptide

SEQ ID NO: 3535 - protein, 450 aa, Artificial Sequence
  Description of Artificial Sequence: Synthetic polypeptide
EVQLLESGGGLVKPGASLKLSCAASGFTFSNHGMSWVRQTSDKRLEWVASITRGGDTTYYPDNVKGRFTISRENAKNTLYLQMSSLKSDDTALYYCTRGPLTVGYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3536 - protein, 214 aa, Artificial Sequence; identical to SEQ ID NO: 2856
  Description of Artificial Sequence: Synthetic polypeptide

SEQ ID NO: 3537 - protein, 5 aa, Artificial Sequence
  Description of Artificial Sequence: Synthetic peptide
NYYWS

SEQ ID NO: 3538 - protein, 16 aa, Artificial Sequence
  Description of Artificial Sequence: Synthetic peptide
RIYSSGITNYNPSLKS

SEQ ID NO: 3539 - protein, 10 aa, Artificial Sequence
  Description of Artificial Sequence: Synthetic peptide
IVGVKGAFAI

SEQ ID NO: 3540 - protein, 14 aa, Artificial Sequence
  Description of Artificial Sequence: Synthetic peptide
TGTSSDVGGYNYVS

SEQ ID NO: 3541 - protein, 7 aa, Artificial Sequence
  Description of Artificial Sequence: Synthetic peptide
EVSNRPS

SEQ ID NO: 3542 - protein, 9 aa, Artificial Sequence
  Description of Artificial Sequence: Synthetic peptide
SSYTSTSVV

SEQ ID NO: 3543 - protein, 7 aa, Artificial Sequence
  Description of Artificial Sequence: Synthetic peptide
GGSISNY

SEQ ID NO: 3544 - protein, 5 aa, Artificial Sequence
  Description of Artificial Sequence: Synthetic peptide
YSSGI

SEQ ID NO: 3545 - protein, 9 aa, Artificial Sequence
  Description of Artificial Sequence: Synthetic peptide
IVGVKGAFA

SEQ ID NO: 3546 - protein, 10 aa, Artificial Sequence
  Description of Artificial Sequence: Synthetic peptide
TSSDVGGYNY

SEQ ID NO: 3547 - protein, 3 aa, Artificial Sequence
  Description of Artificial Sequence: Synthetic peptide
EVS

SEQ ID NO: 3548 - protein, 6 aa, Artificial Sequence
  Description of Artificial Sequence: Synthetic peptide
YTSTSV

SEQ ID NO: 3549 - protein, 10 aa, Artificial Sequence
  Description of Artificial Sequence: Synthetic peptide
GGSISNYYWS

SEQ ID NO: 3550 - protein, 9 aa, Artificial Sequence
  Description of Artificial Sequence: Synthetic peptide
RIYSSGITN

SEQ ID NO: 3551 - protein, 10 aa, Artificial Sequence
  Description of Artificial Sequence: Synthetic peptide
IVGVKGAFAI

SEQ ID NO: 3552 - protein, 14 aa, Artificial Sequence
  Description of Artificial Sequence: Synthetic peptide
TGTSSDVGGYNYVS

SEQ ID NO: 3553 - protein, 7 aa, Artificial Sequence
  Description of Artificial Sequence: Synthetic peptide
EVSNRPS

SEQ ID NO: 3554 - protein, 9 aa, Artificial Sequence
  Description of Artificial Sequence: Synthetic peptide
SSYTSTSVV

SEQ ID NO: 3555 - protein, 6 aa, Artificial Sequence
  Description of Artificial Sequence: Synthetic peptide
SNYYWS

SEQ ID NO: 3556 - protein, 12 aa, Artificial Sequence
  Description of Artificial Sequence: Synthetic peptide
WIGRIYSSGITN

SEQ ID NO: 3557 - protein, 11 aa, Artificial Sequence
  Description of Artificial Sequence: Synthetic peptide
AGIVGVKGAFA

SEQ ID NO: 3558 - protein, 10 aa, Artificial Sequence
  Description of Artificial Sequence: Synthetic peptide
VGGYNYVSWY

SEQ ID NO: 3559 - protein, 10 aa, Artificial Sequence
  Description of Artificial Sequence: Synthetic peptide
LMIYEVSNRP

SEQ ID NO: 3560 - protein, 8 aa, Artificial Sequence
  Description of Artificial Sequence: Synthetic peptide
SSYTSTSV

SEQ ID NO: 3561 - protein, 8 aa, Artificial Sequence
  Description of Artificial Sequence: Synthetic peptide
GGSISNYY

SEQ ID NO: 3562 - protein, 7 aa, Artificial Sequence
  Description of Artificial Sequence: Synthetic peptide
IYSSGIT

SEQ ID NO: 3563 - protein, 12 aa, Artificial Sequence
  Description of Artificial Sequence: Synthetic peptide
AGIVGVKGAFAI

SEQ ID NO: 3564 - protein, 9 aa, Artificial Sequence
  Description of Artificial Sequence: Synthetic peptide
SSDVGGYNY

SEQ ID NO: 3565 - protein, 3 aa, Artificial Sequence
  Description of Artificial Sequence: Synthetic peptide
EVS

SEQ ID NO: 3566 - protein, 9 aa, Artificial Sequence
  Description of Artificial Sequence: Synthetic peptide
SSYTSTSVV

SEQ ID NO: 3567 - protein, 118 aa, Artificial Sequence; identical to SEQ ID NO: 3057
  Description of Artificial Sequence: Synthetic polypeptide

SEQ ID NO: 3568 - protein, 109 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKVTVL

SEQ ID NO: 3569 - protein, 448 aa, Artificial Sequence; identical to SEQ ID NO: 3059
  Description of Artificial Sequence: Synthetic polypeptide

SEQ ID NO: 3570 - protein, 215 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3571 - protein, 5 aa, Artificial Sequence
  Description of Artificial Sequence: Synthetic peptide
NYYWS

SEQ ID NO: 3572 - protein, 16 aa, Artificial Sequence
  Description of Artificial Sequence: Synthetic peptide
RIYSSGITNYNPSLKS

SEQ ID NO: 3573 - protein, 10 aa, Artificial Sequence
  Description of Artificial Sequence: Synthetic peptide
IVGVKGAFAI

SEQ ID NO: 3574 - protein, 14 aa, Artificial Sequence
  Description of Artificial Sequence: Synthetic peptide
TGTSSDVGGYNYVS

SEQ ID NO: 3575 - protein, 7 aa, Artificial Sequence
  Description of Artificial Sequence: Synthetic peptide
EVSNRPS

SEQ ID NO: 3576 - protein, 9 aa, Artificial Sequence
  Description of Artificial Sequence: Synthetic peptide
SSYTSTSVV

SEQ ID NO: 3577 - protein, 7 aa, Artificial Sequence
  Description of Artificial Sequence: Synthetic peptide
GGSISNY

SEQ ID NO: 3578 - protein, 5 aa, Artificial Sequence
  Description of Artificial Sequence: Synthetic peptide
YSSGI

SEQ ID NO: 3579 - protein, 9 aa, Artificial Sequence
  Description of Artificial Sequence: Synthetic peptide
IVGVKGAFA

SEQ ID NO: 3580 - protein, 10 aa, Artificial Sequence
  Description of Artificial Sequence: Synthetic peptide
TSSDVGGYNY

SEQ ID NO: 3581 - protein, 3 aa, Artificial Sequence
  Description of Artificial Sequence: Synthetic peptide
EVS

SEQ ID NO: 3582 - protein, 6 aa, Artificial Sequence
  Description of Artificial Sequence: Synthetic peptide
YTSTSV

SEQ ID NO: 3583 - protein, 10 aa, Artificial Sequence
  Description of Artificial Sequence: Synthetic peptide
GGSISNYYWS

SEQ ID NO: 3584 - protein, 9 aa, Artificial Sequence
  Description of Artificial Sequence: Synthetic peptide
RIYSSGITN

SEQ ID NO: 3585 - protein, 10 aa, Artificial Sequence
  Description of Artificial Sequence: Synthetic peptide
IVGVKGAFAI

SEQ ID NO: 3586 - protein, 14 aa, Artificial Sequence
  Description of Artificial Sequence: Synthetic peptide
TGTSSDVGGYNYVS

SEQ ID NO: 3587 - protein, 7 aa, Artificial Sequence
  Description of Artificial Sequence: Synthetic peptide
EVSNRPS

SEQ ID NO: 3588 - protein, 9 aa, Artificial Sequence
  Description of Artificial Sequence: Synthetic peptide
SSYTSTSVV

SEQ ID NO: 3589 - protein, 6 aa, Artificial Sequence
  Description of Artificial Sequence: Synthetic peptide
SNYYWS

SEQ ID NO: 3590 - protein, 12 aa, Artificial Sequence
  Description of Artificial Sequence: Synthetic peptide
WIGRIYSSGITN

SEQ ID NO: 3591 - protein, 11 aa, Artificial Sequence
  Description of Artificial Sequence: Synthetic peptide
AGIVGVKGAFA

SEQ ID NO: 3592 - protein, 10 aa, Artificial Sequence
  Description of Artificial Sequence: Synthetic peptide
VGGYNYVSWY

SEQ ID NO: 3593 - protein, 10 aa, Artificial Sequence
  Description of Artificial Sequence: Synthetic peptide
LMIYEVSNRP

SEQ ID NO: 3594 - protein, 8 aa, Artificial Sequence
  Description of Artificial Sequence: Synthetic peptide
SSYTSTSV

SEQ ID NO: 3595 - protein, 8 aa, Artificial Sequence
  Description of Artificial Sequence: Synthetic peptide
GGSISNYY

SEQ ID NO: 3596 - protein, 7 aa, Artificial Sequence
  Description of Artificial Sequence: Synthetic peptide
IYSSGIT

SEQ ID NO: 3597 - protein, 12 aa, Artificial Sequence
  Description of Artificial Sequence: Synthetic peptide
AGIVGVKGAFAI

SEQ ID NO: 3598 - protein, 9 aa, Artificial Sequence
  Description of Artificial Sequence: Synthetic peptide
SSDVGGYNY

SEQ ID NO: 3599 - protein, 3 aa, Artificial Sequence
  Description of Artificial Sequence: Synthetic peptide
EVS

SEQ ID NO: 3600 - protein, 9 aa, Artificial Sequence
  Description of Artificial Sequence: Synthetic peptide
SSYTSTSVV

SEQ ID NO: 3601 - protein, 118 aa, Artificial Sequence; identical to SEQ ID NO: 3329
  Description of Artificial Sequence: Synthetic polypeptide

SEQ ID NO: 3602 - protein, 109 aa, Artificial Sequence; identical to SEQ ID NO: 3364
  Description of Artificial Sequence: Synthetic polypeptide

SEQ ID NO: 3603 - protein, 448 aa, Artificial Sequence; identical to SEQ ID NO: 3331
  Description of Artificial Sequence: Synthetic polypeptide

SEQ ID NO: 3604 - protein, 215 aa, Artificial Sequence; identical to SEQ ID NO: 3366
  Description of Artificial Sequence: Synthetic polypeptide

SEQ ID NO: 3605 - protein, 5 aa, Artificial Sequence
  Description of Artificial Sequence: Synthetic peptide
NYYWS

SEQ ID NO: 3606 - protein, 16 aa, Artificial Sequence
  Description of Artificial Sequence: Synthetic peptide
RIYSSGITNYNPSLKS

SEQ ID NO: 3607 - protein, 10 aa, Artificial Sequence
  Description of Artificial Sequence: Synthetic peptide
IVGVKGAFAI

SEQ ID NO: 3608 - protein, 14 aa, Artificial Sequence
  Description of Artificial Sequence: Synthetic peptide
TGTSSDVGGYNYVS

SEQ ID NO: 3609 - protein, 7 aa, Artificial Sequence
  Description of Artificial Sequence: Synthetic peptide
EVSNRPS

SEQ ID NO: 3610 - protein, 9 aa, Artificial Sequence
  Description of Artificial Sequence: Synthetic peptide
SSYTSTSVV

SEQ ID NO: 3611 - protein, 7 aa, Artificial Sequence
  Description of Artificial Sequence: Synthetic peptide
GGSISNY

SEQ ID NO: 3612 - protein, 5 aa, Artificial Sequence
  Description of Artificial Sequence: Synthetic peptide
YSSGI

SEQ ID NO: 3613 - protein, 9 aa, Artificial Sequence
  Description of Artificial Sequence: Synthetic peptide
IVGVKGAFA

SEQ ID NO: 3614 - protein, 10 aa, Artificial Sequence
  Description of Artificial Sequence: Synthetic peptide
TSSDVGGYNY

SEQ ID NO: 3615 - protein, 3 aa, Artificial Sequence
  Description of Artificial Sequence: Synthetic peptide
EVS

SEQ ID NO: 3616 - protein, 6 aa, Artificial Sequence
  Description of Artificial Sequence: Synthetic peptide
YTSTSV

SEQ ID NO: 3617 - protein, 10 aa, Artificial Sequence
  Description of Artificial Sequence: Synthetic peptide
GGSISNYYWS

SEQ ID NO: 3618 - protein, 9 aa, Artificial Sequence
  Description of Artificial Sequence: Synthetic peptide
RIYSSGITN

SEQ ID NO: 3619 - protein, 10 aa, Artificial Sequence
  Description of Artificial Sequence: Synthetic peptide
IVGVKGAFAI

SEQ ID NO: 3620 - protein, 14 aa, Artificial Sequence
  Description of Artificial Sequence: Synthetic peptide
TGTSSDVGGYNYVS

SEQ ID NO: 3621 - protein, 7 aa, Artificial Sequence
  Description of Artificial Sequence: Synthetic peptide
EVSNRPS

SEQ ID NO: 3622 - protein, 9 aa, Artificial Sequence
  Description of Artificial Sequence: Synthetic peptide
SSYTSTSVV

SEQ ID NO: 3623 - protein, 6 aa, Artificial Sequence
  Description of Artificial Sequence: Synthetic peptide
SNYYWS

SEQ ID NO: 3624 - protein, 12 aa, Artificial Sequence
  Description of Artificial Sequence: Synthetic peptide
WIGRIYSSGITN

SEQ ID NO: 3625 - protein, 11 aa, Artificial Sequence
  Description of Artificial Sequence: Synthetic peptide
AGIVGVKGAFA

SEQ ID NO: 3626 - protein, 10 aa, Artificial Sequence
  Description of Artificial Sequence: Synthetic peptide
VGGYNYVSWY

SEQ ID NO: 3627 - protein, 10 aa, Artificial Sequence
  Description of Artificial Sequence: Synthetic peptide
LMIYEVSNRP

SEQ ID NO: 3628 - protein, 8 aa, Artificial Sequence
  Description of Artificial Sequence: Synthetic peptide
SSYTSTSV

SEQ ID NO: 3629 - protein, 8 aa, Artificial Sequence
  Description of Artificial Sequence: Synthetic peptide
GGSISNYY

SEQ ID NO: 3630 - protein, 7 aa, Artificial Sequence
  Description of Artificial Sequence: Synthetic peptide
IYSSGIT

SEQ ID NO: 3631 - protein, 12 aa, Artificial Sequence
  Description of Artificial Sequence: Synthetic peptide
AGIVGVKGAFAI

SEQ ID NO: 3632 - protein, 9 aa, Artificial Sequence
  Description of Artificial Sequence: Synthetic peptide
SSDVGGYNY

SEQ ID NO: 3633 - protein, 3 aa, Artificial Sequence
  Description of Artificial Sequence: Synthetic peptide
EVS

SEQ ID NO: 3634 - protein, 9 aa, Artificial Sequence
  Description of Artificial Sequence: Synthetic peptide
SSYTSTSVV

SEQ ID NO: 3635 - protein, 118 aa, Artificial Sequence
  Description of Artificial Sequence: Synthetic polypeptide
QVQLVESGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTMVTVSS

SEQ ID NO: 3636 - protein, 109 aa, Artificial Sequence
  Description of Artificial Sequence: Synthetic polypeptide
SYELTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKLTVL

SEQ ID NO: 3637 - protein, 448 aa, Artificial Sequence
  Description of Artificial Sequence: Synthetic polypeptide
QVQLVESGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3638 - protein, 215 aa, Artificial Sequence
  Description of Artificial Sequence: Synthetic polypeptide
SYELTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3639 - protein, 5 aa, Artificial Sequence
  Description of Artificial Sequence: Synthetic peptide
NYYWS

SEQ ID NO: 3640 - protein, 16 aa, Artificial Sequence
  Description of Artificial Sequence: Synthetic peptide
RIYSSGITNYNPSLKS

SEQ ID NO: 3641 - protein, 10 aa, Artificial Sequence
  Description of Artificial Sequence: Synthetic peptide
IVGVKGAFAI

SEQ ID NO: 3642 - protein, 14 aa, Artificial Sequence
  Description of Artificial Sequence: Synthetic peptide
TGTSSDVGGYNYVS

SEQ ID NO: 3643 - protein, 7 aa, Artificial Sequence
  Description of Artificial Sequence: Synthetic peptide
EVSNRPS

SEQ ID NO: 3644 - protein, 9 aa, Artificial Sequence
  Description of Artificial Sequence: Synthetic peptide
SSYTSTSVV

SEQ ID NO: 3645 - protein, 7 aa, Artificial Sequence
  Description of Artificial Sequence: Synthetic peptide
GGSISNY

SEQ ID NO: 3646 - protein, 5 aa, Artificial Sequence
  Description of Artificial Sequence: Synthetic peptide
YSSGI

SEQ ID NO: 3647 - protein, 9 aa, Artificial Sequence
  Description of Artificial Sequence: Synthetic peptide
IVGVKGAFA

SEQ ID NO: 3648 - protein, 10 aa, Artificial Sequence
  Description of Artificial Sequence: Synthetic peptide
TSSDVGGYNY

SEQ ID NO: 3649 - protein, 3 aa, Artificial Sequence
  Description of Artificial Sequence: Synthetic peptide
EVS

SEQ ID NO: 3650 - protein, 6 aa, Artificial Sequence
  Description of Artificial Sequence: Synthetic peptide
YTSTSV

SEQ ID NO: 3651 - protein, 10 aa, Artificial Sequence
  Description of Artificial Sequence: Synthetic peptide
GGSISNYYWS

SEQ ID NO: 3652 - protein, 9 aa, Artificial Sequence
  Description of Artificial Sequence: Synthetic peptide
RIYSSGITN

SEQ ID NO: 3653 - protein, 10 aa, Artificial Sequence
  Description of Artificial Sequence: Synthetic peptide
IVGVKGAFAI

SEQ ID NO: 3654 - protein, 14 aa, Artificial Sequence
  Description of Artificial Sequence: Synthetic peptide
TGTSSDVGGYNYVS

SEQ ID NO: 3655 - protein, 7 aa, Artificial Sequence
  Description of Artificial Sequence: Synthetic peptide
EVSNRPS

SEQ ID NO: 3656 - protein, 9 aa, Artificial Sequence
  Description of Artificial Sequence: Synthetic peptide
SSYTSTSVV

SEQ ID NO: 3657 - protein, 6 aa, Artificial Sequence
  Description of Artificial Sequence: Synthetic peptide
SNYYWS

SEQ ID NO: 3658 - protein, 12 aa, Artificial Sequence
  Description of Artificial Sequence: Synthetic peptide
WIGRIYSSGITN

SEQ ID NO: 3659 - protein, 11 aa, Artificial Sequence
  Description of Artificial Sequence: Synthetic peptide
AGIVGVKGAFA

SEQ ID NO: 3660 - protein, 10 aa, Artificial Sequence
  Description of Artificial Sequence: Synthetic peptide
VGGYNYVSWY

SEQ ID NO: 3661 - protein, 10 aa, Artificial Sequence
  Description of Artificial Sequence: Synthetic peptide
LMIYEVSNRP

SEQ ID NO: 3662 - protein, 8 aa, Artificial Sequence
  Description of Artificial Sequence: Synthetic peptide
SSYTSTSV

SEQ ID NO: 3663 - protein, 8 aa, Artificial Sequence
  Description of Artificial Sequence: Synthetic peptide
GGSISNYY

SEQ ID NO: 3664 - protein, 7 aa, Artificial Sequence
  Description of Artificial Sequence: Synthetic peptide
IYSSGIT

SEQ ID NO: 3665 - protein, 12 aa, Artificial Sequence
  Description of Artificial Sequence: Synthetic peptide
AGIVGVKGAFAI

SEQ ID NO: 3666 - protein, 9 aa, Artificial Sequence
  Description of Artificial Sequence: Synthetic peptide
SSDVGGYNY

SEQ ID NO: 3667 - protein, 3 aa, Artificial Sequence
  Description of Artificial Sequence: Synthetic peptide
EVS

SEQ ID NO: 3668 - protein, 9 aa, Artificial Sequence
  Description of Artificial Sequence: Synthetic peptide
SSYTSTSVV

SEQ ID NO: 3669 - protein, 118 aa, Artificial Sequence; identical to SEQ ID NO: 3227
  Description of Artificial Sequence: Synthetic polypeptide

SEQ ID NO: 3670 - protein, 109 aa, Artificial Sequence; identical to SEQ ID NO: 3636
  Description of Artificial Sequence: Synthetic polypeptide

SEQ ID NO: 3671 - protein, 448 aa, Artificial Sequence; identical to SEQ ID NO: 3229
  Description of Artificial Sequence: Synthetic polypeptide

SEQ ID NO: 3672 - protein, 215 aa, Artificial Sequence; identical to SEQ ID NO: 3638
  Description of Artificial Sequence: Synthetic polypeptide

SEQ ID NO: 3673 - protein, 5 aa, Artificial Sequence
  Description of Artificial Sequence: Synthetic peptide
NYYWS

SEQ ID NO: 3674 - protein, 16 aa, Artificial Sequence
  Description of Artificial Sequence: Synthetic peptide
RIYSSGITNYNPSLKS

SEQ ID NO: 3675 - protein, 10 aa, Artificial Sequence
  Description of Artificial Sequence: Synthetic peptide
IVGVKGAFAI

SEQ ID NO: 3676 - protein, 14 aa, Artificial Sequence
  Description of Artificial Sequence: Synthetic peptide
TGTSSDVGGYNYVS

SEQ ID NO: 3677 - protein, 7 aa, Artificial Sequence
  Description of Artificial Sequence: Synthetic peptide
EVSNRPS

SEQ ID NO: 3678 - protein, 9 aa, Artificial Sequence
  Description of Artificial Sequence: Synthetic peptide
SSYTSTSVV

SEQ ID NO: 3679 - protein, 7 aa, Artificial Sequence
  Description of Artificial Sequence: Synthetic peptide
GGSISNY

SEQ ID NO: 3680 - protein, 5 aa, Artificial Sequence
  Description of Artificial Sequence: Synthetic peptide
YSSGI

SEQ ID NO: 3681 - protein, 9 aa, Artificial Sequence
  Description of Artificial Sequence: Synthetic peptide
IVGVKGAFA

SEQ ID NO: 3682 - protein, 10 aa, Artificial Sequence
  Description of Artificial Sequence: Synthetic peptide
TSSDVGGYNY

SEQ ID NO: 3683 - protein, 3 aa, Artificial Sequence
  Description of Artificial Sequence: Synthetic peptide
EVS

SEQ ID NO: 3684 - protein, 6 aa, Artificial Sequence
  Description of Artificial Sequence: Synthetic peptide
YTSTSV

SEQ ID NO: 3685 - protein, 10 aa, Artificial Sequence
  Description of Artificial Sequence: Synthetic peptide
GGSISNYYWS

SEQ ID NO: 3686 - protein, 9 aa, Artificial Sequence
  Description of Artificial Sequence: Synthetic peptide
RIYSSGITN

SEQ ID NO: 3687 - protein, 10 aa, Artificial Sequence
  Description of Artificial Sequence: Synthetic peptide
IVGVKGAFAI

SEQ ID NO: 3688 - protein, 14 aa, Artificial Sequence
  Description of Artificial Sequence: Synthetic peptide
TGTSSDVGGYNYVS

SEQ ID NO: 3689 - protein, 7 aa, Artificial Sequence
  Description of Artificial Sequence: Synthetic peptide
EVSNRPS

SEQ ID NO: 3690 - protein, 9 aa, Artificial Sequence
  Description of Artificial Sequence: Synthetic peptide
SSYTSTSVV

SEQ ID NO: 3691 - protein, 6 aa, Artificial Sequence
  Description of Artificial Sequence: Synthetic peptide
SNYYWS

SEQ ID NO: 3692 - protein, 12 aa, Artificial Sequence
  Description of Artificial Sequence: Synthetic peptide
WIGRIYSSGITN

SEQ ID NO: 3693 - protein, 11 aa, Artificial Sequence
  Description of Artificial Sequence: Synthetic peptide
AGIVGVKGAFA

SEQ ID NO: 3694 - protein, 10 aa, Artificial Sequence
  Description of Artificial Sequence: Synthetic peptide
VGGYNYVSWY

SEQ ID NO: 3695 - protein, 10 aa, Artificial Sequence
  Description of Artificial Sequence: Synthetic peptide
LMIYEVSNRP

SEQ ID NO: 3696 - protein, 8 aa, Artificial Sequence
  Description of Artificial Sequence: Synthetic peptide
SSYTSTSV

SEQ ID NO: 3697 - protein, 8 aa, Artificial Sequence
  Description of Artificial Sequence: Synthetic peptide
GGSISNYY

SEQ ID NO: 3698 - protein, 7 aa, Artificial Sequence
  Description of Artificial Sequence: Synthetic peptide
IYSSGIT

SEQ ID NO: 3699 - protein, 12 aa, Artificial Sequence
  Description of Artificial Sequence: Synthetic peptide
AGIVGVKGAFAI

SEQ ID NO: 3700 - protein, 9 aa, Artificial Sequence
  Description of Artificial Sequence: Synthetic peptide
SSDVGGYNY

SEQ ID NO: 3701 - protein, 3 aa, Artificial Sequence
  Description of Artificial Sequence: Synthetic peptide
EVS

SEQ ID NO: 3702 - protein, 9 aa, Artificial Sequence
  Description of Artificial Sequence: Synthetic peptide
SSYTSTSVV

SEQ ID NO: 3703 - protein, 118 aa, Artificial Sequence
  Description of Artificial Sequence: Synthetic polypeptide
EVQLQESGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTMVTVSS

SEQ ID NO: 3704 - protein, 109 aa, Artificial Sequence; identical to SEQ ID NO: 3058
  Description of Artificial Sequence: Synthetic polypeptide

SEQ ID NO: 3705 - protein, 448 aa, Artificial Sequence
  Description of Artificial Sequence: Synthetic polypeptide
EVQLQESGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3706 - protein, 215 aa, Artificial Sequence; identical to SEQ ID NO: 3060
  Description of Artificial Sequence: Synthetic polypeptide

SEQ ID NO: 3707 - protein, 5 aa, Artificial Sequence
  Description of Artificial Sequence: Synthetic peptide
NYYWS

SEQ ID NO: 3708 - protein, 16 aa, Artificial Sequence
  Description of Artificial Sequence: Synthetic peptide
RIYSSGITNYNPSLKS

SEQ ID NO: 3709 - protein, 10 aa, Artificial Sequence
  Description of Artificial Sequence: Synthetic peptide
IVGVKGAFAI

SEQ ID NO: 3710 - protein, 14 aa, Artificial Sequence
  Description of Artificial Sequence: Synthetic peptide
TGTSSDVGGYNYVS

SEQ ID NO: 3711 - protein, 7 aa, Artificial Sequence
  Description of Artificial Sequence: Synthetic peptide
EVSNRPS

SEQ ID NO: 3712 - protein, 9 aa, Artificial Sequence
  Description of Artificial Sequence: Synthetic peptide
SSYTSTSVV

SEQ ID NO: 3713 - protein, 7 aa, Artificial Sequence
  Description of Artificial Sequence: Synthetic peptide
GGSISNY

SEQ ID NO: 3714 - protein, 5 aa, Artificial Sequence
  Description of Artificial Sequence: Synthetic peptide
YSSGI

SEQ ID NO: 3715 - protein, 9 aa, Artificial Sequence
  Description of Artificial Sequence: Synthetic peptide
IVGVKGAFA

SEQ ID NO: 3716 - protein, 10 aa, Artificial Sequence
  Description of Artificial Sequence: Synthetic peptide
TSSDVGGYNY

SEQ ID NO: 3717 - protein, 3 aa, Artificial Sequence
  Description of Artificial Sequence: Synthetic peptide
EVS

SEQ ID NO: 3718 - protein, 6 aa, Artificial Sequence
  Description of Artificial Sequence: Synthetic peptide
YTSTSV

SEQ ID NO: 3719 - protein, 10 aa, Artificial Sequence
  Description of Artificial Sequence: Synthetic peptide
GGSISNYYWS

SEQ ID NO: 3720 - protein, 9 aa, Artificial Sequence
  Description of Artificial Sequence: Synthetic peptide
RIYSSGITN

SEQ ID NO: 3721 - protein, 10 aa, Artificial Sequence
  Description of Artificial Sequence: Synthetic peptide
IVGVKGAFAI

SEQ ID NO: 3722 - protein, 14 aa, Artificial Sequence
  Description of Artificial Sequence: Synthetic peptide
TGTSSDVGGYNYVS

SEQ ID NO: 3723 - protein, 7 aa, Artificial Sequence
  Description of Artificial Sequence: Synthetic peptide
EVSNRPS

SEQ ID NO: 3724 - protein, 9 aa, Artificial Sequence
  Description of Artificial Sequence: Synthetic peptide
SSYTSTSVV

SEQ ID NO: 3725 - protein, 6 aa, Artificial Sequence
  Description of Artificial Sequence: Synthetic peptide
SNYYWS

SEQ ID NO: 3726 - protein, 12 aa, Artificial Sequence
  Description of Artificial Sequence: Synthetic peptide
WIGRIYSSGITN

SEQ ID NO: 3727 - protein, 11 aa, Artificial Sequence
  Description of Artificial Sequence: Synthetic peptide
AGIVGVKGAFA

SEQ ID NO: 3728 - protein, 10 aa, Artificial Sequence
  Description of Artificial Sequence: Synthetic peptide
VGGYNYVSWY

SEQ ID NO: 3729 - protein, 10 aa, Artificial Sequence
  Description of Artificial Sequence: Synthetic peptide
LMIYEVSNRP

SEQ ID NO: 3730 - protein, 8 aa, Artificial Sequence
  Description of Artificial Sequence: Synthetic peptide
SSYTSTSV

SEQ ID NO: 3731 - protein, 8 aa, Artificial Sequence
  Description of Artificial Sequence: Synthetic peptide
GGSISNYY

SEQ ID NO: 3732 - protein, 7 aa, Artificial Sequence
  Description of Artificial Sequence: Synthetic peptide
IYSSGIT

SEQ ID NO: 3733 - protein, 12 aa, Artificial Sequence
  Description of Artificial Sequence: Synthetic peptide
AGIVGVKGAFAI

SEQ ID NO: 3734 - protein, 9 aa, Artificial Sequence
  Description of Artificial Sequence: Synthetic peptide
SSDVGGYNY

SEQ ID NO: 3735 - protein, 3 aa, Artificial Sequence
  Description of Artificial Sequence: Synthetic peptide
EVS

SEQ ID NO: 3736 - protein, 9 aa, Artificial Sequence
  Description of Artificial Sequence: Synthetic peptide
SSYTSTSVV

SEQ ID NO: 3737 - protein, 118 aa, Artificial Sequence
  Description of Artificial Sequence: Synthetic polypeptide
EVQLVESGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTMVTVSS

SEQ ID NO: 3738 - protein, 109 aa, Artificial Sequence; identical to SEQ ID NO: 3636
  Description of Artificial Sequence: Synthetic polypeptide

SEQ ID NO: 3739 - protein, 448 aa, Artificial Sequence
  Description of Artificial Sequence: Synthetic polypeptide
EVQLVESGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3740 - protein, 215 aa, Artificial Sequence; identical to SEQ ID NO: 3638
  Description of Artificial Sequence: Synthetic polypeptide

SEQ ID NO: 3741 - protein, 5 aa, Artificial Sequence
  Description of Artificial Sequence: Synthetic peptide
NYYWS

SEQ ID NO: 3742 - protein, 16 aa, Artificial Sequence
  Description of Artificial Sequence: Synthetic peptide
RIYSSGITNYNPSLKS

SEQ ID NO: 3743 - protein, 10 aa, Artificial Sequence
  Description of Artificial Sequence: Synthetic peptide
IVGVKGAFAI

SEQ ID NO: 3744 - protein, 14 aa, Artificial Sequence
  Description of Artificial Sequence: Synthetic peptide
TGTSSDVGGYNYVS

SEQ ID NO: 3745 - protein, 7 aa, Artificial Sequence
  Description of Artificial Sequence: Synthetic peptide
EVSNRPS

SEQ ID NO: 3746 - protein, 9 aa, Artificial Sequence
  Description of Artificial Sequence: Synthetic peptide
SSYTSTSVV

SEQ ID NO: 3747 - protein, 7 aa, Artificial Sequence
  Description of Artificial Sequence: Synthetic peptide
GGSISNY

SEQ ID NO: 3748 - protein, 5 aa, Artificial Sequence
  Description of Artificial Sequence: Synthetic peptide
YSSGI

SEQ ID NO: 3749 - protein, 9 aa, Artificial Sequence
  Description of Artificial Sequence: Synthetic peptide
IVGVKGAFA

SEQ ID NO: 3750 - protein, 10 aa, Artificial Sequence
  Description of Artificial Sequence: Synthetic peptide
TSSDVGGYNY

SEQ ID NO: 3751 - protein, 3 aa, Artificial Sequence
  Description of Artificial Sequence: Synthetic peptide
EVS

SEQ ID NO: 3752 - protein, 6 aa, Artificial Sequence
  Description of Artificial Sequence: Synthetic peptide
YTSTSV

SEQ ID NO: 3753 - protein, 10 aa, Artificial Sequence
  Description of Artificial Sequence: Synthetic peptide
GGSISNYYWS

SEQ ID NO: 3754 - protein, 9 aa, Artificial Sequence
  Description of Artificial Sequence: Synthetic peptide
RIYSSGITN

SEQ ID NO: 3755 - protein, 10 aa, Artificial Sequence
  Description of Artificial Sequence: Synthetic peptide
IVGVKGAFAI

SEQ ID NO: 3756 - protein, 14 aa, Artificial Sequence
  Description of Artificial Sequence: Synthetic peptide
TGTSSDVGGYNYVS

SEQ ID NO: 3757 - protein, 7 aa, Artificial Sequence
  Description of Artificial Sequence: Synthetic peptide
EVSNRPS

SEQ ID NO: 3758 - protein, 9 aa, Artificial Sequence
  Description of Artificial Sequence: Synthetic peptide
SSYTSTSVV

SEQ ID NO: 3759 - protein, 6 aa, Artificial Sequence
  Description of Artificial Sequence: Synthetic peptide
SNYYWS

SEQ ID NO: 3760 - protein, 12 aa, Artificial Sequence
  Description of Artificial Sequence: Synthetic peptide
WIGRIYSSGITN

SEQ ID NO: 3761 - protein, 11 aa, Artificial Sequence
  Description of Artificial Sequence: Synthetic peptide
AGIVGVKGAFA

SEQ ID NO: 3762 - protein, 10 aa, Artificial Sequence
  Description of Artificial Sequence: Synthetic peptide
VGGYNYVSWY

SEQ ID NO: 3763 - protein, 10 aa, Artificial Sequence
  Description of Artificial Sequence: Synthetic peptide
LMIYEVSNRP

SEQ ID NO: 3764 - protein, 8 aa, Artificial Sequence
  Description of Artificial Sequence: Synthetic peptide
SSYTSTSV

SEQ ID NO: 3765 - protein, 8 aa, Artificial Sequence
  Description of Artificial Sequence: Synthetic peptide
GGSISNYY

SEQ ID NO: 3766 - protein, 7 aa, Artificial Sequence
  Description of Artificial Sequence: Synthetic peptide
IYSSGIT

SEQ ID NO: 3767 - protein, 12 aa, Artificial Sequence
  Description of Artificial Sequence: Synthetic peptide
AGIVGVKGAFAI

SEQ ID NO: 3768 - protein, 9 aa, Artificial Sequence
  Description of Artificial Sequence: Synthetic peptide
SSDVGGYNY

SEQ ID NO: 3769 - protein, 3 aa, Artificial Sequence
  Description of Artificial Sequence: Synthetic peptide
EVS

SEQ ID NO: 3770 - protein, 9 aa, Artificial Sequence
  Description of Artificial Sequence: Synthetic peptide
SSYTSTSVV

SEQ ID NO: 3771 - protein, 118 aa, Artificial Sequence
  Description of Artificial Sequence: Synthetic polypeptide
EVQLVQSGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTTVTVSS

SEQ ID NO: 3772 - protein, 109 aa, Artificial Sequence; identical to SEQ ID NO: 3364
  Description of Artificial Sequence: Synthetic polypeptide

SEQ ID NO: 3773 - protein, 448 aa, Artificial Sequence
  Description of Artificial Sequence: Synthetic polypeptide
EVQLVQSGPGLVKPSETLSLTCTVSGGSISNYYWSWIRQPAGKGLGWIGRIYSSGITNYNPSLKSRVTMSVDTSKNQLSLKLSSVTAADTAVYYCAGIVGVKGAFAIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3774 - protein, 215 aa, Artificial Sequence; identical to SEQ ID NO: 3366
  Description of Artificial Sequence: Synthetic polypeptide

SEQ ID NO: 3775 - protein, 5 aa, Artificial Sequence
  Description of Artificial Sequence: Synthetic peptide
NYYWS

SEQ ID NO: 3776 - protein, 16 aa, Artificial Sequence
  Description of Artificial Sequence: Synthetic peptide
RIYSSGITNYNPSLKS

SEQ ID NO: 3777 - protein, 10 aa, Artificial Sequence
  Description of Artificial Sequence: Synthetic peptide
IVGVKGAFAI

SEQ ID NO: 3778 - protein, 14 aa, Artificial Sequence
  Description of Artificial Sequence: Synthetic peptide
TGTSSDVGGYNYVS

SEQ ID NO: 3779 - protein, 7 aa, Artificial Sequence
  Description of Artificial Sequence: Synthetic peptide
EVSNRPS

SEQ ID NO: 3780 - protein, 9 aa, Artificial Sequence
  Description of Artificial Sequence: Synthetic peptide
SSYTSTSVV

SEQ ID NO: 3781 - protein, 7 aa, Artificial Sequence
  Description of Artificial Sequence: Synthetic peptide
GGSISNY

SEQ ID NO: 3782 - protein, 5 aa, Artificial Sequence
  Description of Artificial Sequence: Synthetic peptide
YSSGI

SEQ ID NO: 3783 - protein, 9 aa, Artificial Sequence
  Description of Artificial Sequence: Synthetic peptide
IVGVKGAFA

SEQ ID NO: 3784 - protein, 10 aa, Artificial Sequence
  Description of Artificial Sequence: Synthetic peptide
TSSDVGGYNY

SEQ ID NO: 3785 - protein, 3 aa, Artificial Sequence
  Description of Artificial Sequence: Synthetic peptide
EVS

SEQ ID NO: 3786 - protein, 6 aa, Artificial Sequence
  Description of Artificial Sequence: Synthetic peptide
YTSTSV

SEQ ID NO: 3787 - protein, 10 aa, Artificial Sequence
  Description of Artificial Sequence: Synthetic peptide
GGSISNYYWS

SEQ ID NO: 3788 - protein, 9 aa, Artificial Sequence
  Description of Artificial Sequence: Synthetic peptide
RIYSSGITN

SEQ ID NO: 3789 - protein, 10 aa, Artificial Sequence
  Description of Artificial Sequence: Synthetic peptide
IVGVKGAFAI

SEQ ID NO: 3790 - protein, 14 aa, Artificial Sequence
  Description of Artificial Sequence: Synthetic peptide
TGTSSDVGGYNYVS

SEQ ID NO: 3791 - protein, 7 aa, Artificial Sequence
  Description of Artificial Sequence: Synthetic peptide
EVSNRPS

SEQ ID NO: 3792 - protein, 9 aa, Artificial Sequence
  Description of Artificial Sequence: Synthetic peptide
SSYTSTSVV

SEQ ID NO: 3793 - protein, 6 aa, Artificial Sequence
  Description of Artificial Sequence: Synthetic peptide
SNYYWS

SEQ ID NO: 3794 - protein, 12 aa, Artificial Sequence
  Description of Artificial Sequence: Synthetic peptide
WIGRIYSSGITN

SEQ ID NO: 3795 - protein, 11 aa, Artificial Sequence
  Description of Artificial Sequence: Synthetic peptide
AGIVGVKGAFA

SEQ ID NO: 3796 - protein, 10 aa, Artificial Sequence
  Description of Artificial Sequence: Synthetic peptide
VGGYNYVSWY

SEQ ID NO: 3797 - protein, 10 aa, Artificial Sequence
  Description of Artificial Sequence: Synthetic peptide
LMIYEVSNRP

SEQ ID NO: 3798 - protein, 8 aa, Artificial Sequence
  Description of Artificial Sequence: Synthetic peptide
SSYTSTSV

SEQ ID NO: 3799 - protein, 8 aa, Artificial Sequence
  Description of Artificial Sequence: Synthetic peptide
GGSISNYY

SEQ ID NO: 3800 - protein, 7 aa, Artificial Sequence
  Description of Artificial Sequence: Synthetic peptide
IYSSGIT

SEQ ID NO: 3801 - protein, 12 aa, Artificial Sequence
  Description of Artificial Sequence: Synthetic peptide
AGIVGVKGAFAI

SEQ ID NO: 3802 - protein, 9 aa, Artificial Sequence
  Description of Artificial Sequence: Synthetic peptide
SSDVGGYNY

SEQ ID NO: 3803 - protein, 3 aa, Artificial Sequence
  Description of Artificial Sequence: Synthetic peptide
EVS

SEQ ID NO: 3804 - protein, 9 aa, Artificial Sequence
  Description of Artificial Sequence: Synthetic peptide
SSYTSTSVV

SEQ ID NO: 3805 - protein, 118 aa, Artificial Sequence; identical to SEQ ID NO: 3703
  Description of Artificial Sequence: Synthetic polypeptide

SEQ ID NO: 3806 - protein, 109 aa, Artificial Sequence; identical to SEQ ID NO: 3364
  Description of Artificial Sequence: Synthetic polypeptide

SEQ ID NO: 3807 - protein, 448 aa, Artificial Sequence; identical to SEQ ID NO: 3705
  Description of Artificial Sequence: Synthetic polypeptide

SEQ ID NO: 3808 - protein, 215 aa, Artificial Sequence; identical to SEQ ID NO: 3366
  Description of Artificial Sequence: Synthetic polypeptide

SEQ ID NO: 3809 - protein, 5 aa, Artificial Sequence
  Description of Artificial Sequence: Synthetic peptide
NYYWS

SEQ ID NO: 3810 - protein, 16 aa, Artificial Sequence
  Description of Artificial Sequence: Synthetic peptide
RIYSSGITNYNPSLKS

SEQ ID NO: 3811 - protein, 10 aa, Artificial Sequence
  Description of Artificial Sequence: Synthetic peptide
IVGVKGAFAI

SEQ ID NO: 3812 - protein, 14 aa, Artificial Sequence
  Description of Artificial Sequence: Synthetic peptide
TGTSSDVGGYNYVS

SEQ ID NO: 3813 - protein, 7 aa, Artificial Sequence
  Description of Artificial Sequence: Synthetic peptide
EVSNRPS

SEQ ID NO: 3814 - protein, 9 aa, Artificial Sequence
  Description of Artificial Sequence: Synthetic peptide
SSYTSTSVV

SEQ ID NO: 3815 - protein, 7 aa, Artificial Sequence
  Description of Artificial Sequence: Synthetic peptide
GGSISNY

SEQ ID NO: 3816 - protein, 5 aa, Artificial Sequence
  Description of Artificial Sequence: Synthetic peptide
YSSGI

SEQ ID NO: 3817 - protein, 9 aa, Artificial Sequence
  Description of Artificial Sequence: Synthetic peptide
IVGVKGAFA

SEQ ID NO: 3818 - protein, 10 aa, Artificial Sequence
  Description of Artificial Sequence: Synthetic peptide
TSSDVGGYNY

SEQ ID NO: 3819 - protein, 3 aa, Artificial Sequence
  Description of Artificial Sequence: Synthetic peptide
EVS

SEQ ID NO: 3820 - protein, 6 aa, Artificial Sequence
  Description of Artificial Sequence: Synthetic peptide
YTSTSV

SEQ ID NO: 3821 - protein, 10 aa, Artificial Sequence
  Description of Artificial Sequence: Synthetic peptide
GGSISNYYWS

SEQ ID NO: 3822 - protein, 9 aa, Artificial Sequence
  Description of Artificial Sequence: Synthetic peptide
RIYSSGITN

SEQ ID NO: 3823 - protein, 10 aa, Artificial Sequence
  Description of Artificial Sequence: Synthetic peptide
IVGVKGAFAI

SEQ ID NO: 3824 - protein, 14 aa, Artificial Sequence
  Description of Artificial Sequence: Synthetic peptide
TGTSSDVGGYNYVS

SEQ ID NO: 3825 - protein, 7 aa, Artificial Sequence
  Description of Artificial Sequence: Synthetic peptide
EVSNRPS

SEQ ID NO: 3826 - protein, 9 aa, Artificial Sequence
  Description of Artificial Sequence: Synthetic peptide
SSYTSTSVV

SEQ ID NO: 3827 - protein, 6 aa, Artificial Sequence
  Description of Artificial Sequence: Synthetic peptide
SNYYWS

SEQ ID NO: 3828 - protein, 12 aa, Artificial Sequence
  Description of Artificial Sequence: Synthetic peptide
WIGRIYSSGITN

SEQ ID NO: 3829 - protein, 11 aa, Artificial Sequence
  Description of Artificial Sequence: Synthetic peptide
AGIVGVKGAFA

SEQ ID NO: 3830 - protein, 10 aa, Artificial Sequence
  Description of Artificial Sequence: Synthetic peptide
VGGYNYVSWY

SEQ ID NO: 3831 - protein, 10 aa, Artificial Sequence
  Description of Artificial Sequence: Synthetic peptide
LMIYEVSNRP

SEQ ID NO: 3832 - protein, 8 aa, Artificial Sequence
  Description of Artificial Sequence: Synthetic peptide
SSYTSTSV

SEQ ID NO: 3833 - protein, 8 aa, Artificial Sequence
  Description of Artificial Sequence: Synthetic peptide
GGSISNYY

SEQ ID NO: 3834 - protein, 7 aa, Artificial Sequence
  Description of Artificial Sequence: Synthetic peptide
IYSSGIT

SEQ ID NO: 3835 - protein, 12 aa, Artificial Sequence
  Description of Artificial Sequence: Synthetic peptide
AGIVGVKGAFAI

SEQ ID NO: 3836 - protein, 9 aa, Artificial Sequence
  Description of Artificial Sequence: Synthetic peptide
SSDVGGYNY

SEQ ID NO: 3837 - protein, 3 aa, Artificial Sequence
  Description of Artificial Sequence: Synthetic peptide
EVS

SEQ ID NO: 3838 - protein, 9 aa, Artificial Sequence
  Description of Artificial Sequence: Synthetic peptide
SSYTSTSVV

SEQ ID NO: 3839 - protein, 118 aa, Artificial Sequence; identical to SEQ ID NO: 3737
  Description of Artificial Sequence: Synthetic polypeptide

SEQ ID NO: 3840 - protein, 109 aa, Artificial Sequence; identical to SEQ ID NO: 3330
  Description of Artificial Sequence: Synthetic polypeptide

SEQ ID NO: 3841 - protein, 448 aa, Artificial Sequence; identical to SEQ ID NO: 3739
  Description of Artificial Sequence: Synthetic polypeptide

SEQ ID NO: 3842 - protein, 215 aa, Artificial Sequence; identical to SEQ ID NO: 3332
  Description of Artificial Sequence: Synthetic polypeptide

SEQ ID NO: 3843 - protein, 5 aa, Artificial Sequence
  Description of Artificial Sequence: Synthetic peptide
NYYWS

SEQ ID NO: 3844 - protein, 16 aa, Artificial Sequence
  Description of Artificial Sequence: Synthetic peptide
RIYSSGITNYNPSLKS

SEQ ID NO: 3845 - protein, 10 aa, Artificial Sequence
  Description of Artificial Sequence: Synthetic peptide
IVGVKGAFAI

SEQ ID NO: 3846 - protein, 14 aa, Artificial Sequence
  Description of Artificial Sequence: Synthetic peptide
TGTSSDVGGYNYVS

SEQ ID NO: 3847 - protein, 7 aa, Artificial Sequence
  Description of Artificial Sequence: Synthetic peptide
EVSNRPS

SEQ ID NO: 3848 - protein, 9 aa, Artificial Sequence
  Description of Artificial Sequence: Synthetic peptide
SSYTSTSVV

SEQ ID NO: 3849 - protein, 7 aa, Artificial Sequence
  Description of Artificial Sequence: Synthetic peptide
GGSISNY

SEQ ID NO: 3850 - protein, 5 aa, Artificial Sequence
  Description of Artificial Sequence: Synthetic peptide
YSSGI

SEQ ID NO: 3851 - protein, 9 aa, Artificial Sequence
  Description of Artificial Sequence: Synthetic peptide
IVGVKGAFA

SEQ ID NO: 3852 - protein, 10 aa, Artificial Sequence
  Description of Artificial Sequence: Synthetic peptide
TSSDVGGYNY

SEQ ID NO: 3853 - protein, 3 aa, Artificial Sequence
  Description of Artificial Sequence: Synthetic peptide
EVS

SEQ ID NO: 3854 - protein, 6 aa, Artificial Sequence
  Description of Artificial Sequence: Synthetic peptide
YTSTSV

SEQ ID NO: 3855 - protein, 10 aa, Artificial Sequence
  Description of Artificial Sequence: Synthetic peptide
GGSISNYYWS

SEQ ID NO: 3856 - protein, 9 aa, Artificial Sequence
  Description of Artificial Sequence: Synthetic peptide
RIYSSGITN

SEQ ID NO: 3857 - protein, 10 aa, Artificial Sequence
  Description of Artificial Sequence: Synthetic peptide
IVGVKGAFAI

SEQ ID NO: 3858 - protein, 14 aa, Artificial Sequence
  Description of Artificial Sequence: Synthetic peptide
TGTSSDVGGYNYVS

SEQ ID NO: 3859 - protein, 7 aa, Artificial Sequence
  Description of Artificial Sequence: Synthetic peptide
EVSNRPS

SEQ ID NO: 3860 - protein, 9 aa, Artificial Sequence
  Description of Artificial Sequence: Synthetic peptide
SSYTSTSVV

SEQ ID NO: 3861 - protein, 6 aa, Artificial Sequence
  Description of Artificial Sequence: Synthetic peptide
SNYYWS

SEQ ID NO: 3862 - protein, 12 aa, Artificial Sequence
  Description of Artificial Sequence: Synthetic peptide
WIGRIYSSGITN

SEQ ID NO: 3863 - protein, 11 aa, Artificial Sequence
  Description of Artificial Sequence: Synthetic peptide
AGIVGVKGAFA

SEQ ID NO: 3864 - protein, 10 aa, Artificial Sequence
  Description of Artificial Sequence: Synthetic peptide
VGGYNYVSWY

SEQ ID NO: 3865 - protein, 10 aa, Artificial Sequence
  Description of Artificial Sequence: Synthetic peptide
LMIYEVSNRP

SEQ ID NO: 3866 - protein, 8 aa, Artificial Sequence
  Description of Artificial Sequence: Synthetic peptide
SSYTSTSV

SEQ ID NO: 3867 - protein, 8 aa, Artificial Sequence
  Description of Artificial Sequence: Synthetic peptide
GGSISNYY

SEQ ID NO: 3868 - protein, 7 aa, Artificial Sequence
  Description of Artificial Sequence: Synthetic peptide
IYSSGIT

SEQ ID NO: 3869 - protein, 12 aa, Artificial Sequence
  Description of Artificial Sequence: Synthetic peptide
AGIVGVKGAFAI

SEQ ID NO: 3870 - protein, 9 aa, Artificial Sequence
  Description of Artificial Sequence: Synthetic peptide
SSDVGGYNY

SEQ ID NO: 3871 - protein, 3 aa, Artificial Sequence
  Description of Artificial Sequence: Synthetic peptide
EVS

SEQ ID NO: 3872 - protein, 9 aa, Artificial Sequence
  Description of Artificial Sequence: Synthetic peptide
SSYTSTSVV

SEQ ID NO: 3873 - protein, 118 aa, Artificial Sequence; identical to SEQ ID NO: 3635
  Description of Artificial Sequence: Synthetic polypeptide

SEQ ID NO: 3874 - protein, 109 aa, Artificial Sequence; identical to SEQ ID NO: 3568
  Description of Artificial Sequence: Synthetic polypeptide

SEQ ID NO: 3875 - protein, 448 aa, Artificial Sequence; identical to SEQ ID NO: 3637
  Description of Artificial Sequence: Synthetic polypeptide

SEQ ID NO: 3876 - protein, 215 aa, Artificial Sequence; identical to SEQ ID NO: 3570
  Description of Artificial Sequence: Synthetic polypeptide

SEQ ID NO: 3877 - protein, 5 aa, Artificial Sequence
  Description of Artificial Sequence: Synthetic peptide
NYYWS

SEQ ID NO: 3878 - protein, 16 aa, Artificial Sequence
  Description of Artificial Sequence: Synthetic peptide
RIYSSGITNYNPSLKS

SEQ ID NO: 3879 - protein, 10 aa, Artificial Sequence
  Description of Artificial Sequence: Synthetic peptide
IVGVKGAFAI

SEQ ID NO: 3880 - protein, 14 aa, Artificial Sequence
  Description of Artificial Sequence: Synthetic peptide
TGTSSDVGGYNYVS

SEQ ID NO: 3881 - protein, 7 aa, Artificial Sequence
  Description of Artificial Sequence: Synthetic peptide
EVSNRPS

SEQ ID NO: 3882 - protein, 9 aa, Artificial Sequence
  Description of Artificial Sequence: Synthetic peptide
SSYTSTSVV

SEQ ID NO: 3883 - protein, 7 aa, Artificial Sequence
  Description of Artificial Sequence: Synthetic peptide
GGSISNY

SEQ ID NO: 3884 - protein, 5 aa, Artificial Sequence
  Description of Artificial Sequence: Synthetic peptide
YSSGI

SEQ ID NO: 3885 - protein, 9 aa, Artificial Sequence
  Description of Artificial Sequence: Synthetic peptide
IVGVKGAFA

SEQ ID NO: 3886 - protein, 10 aa, Artificial Sequence
  Description of Artificial Sequence: Synthetic peptide
TSSDVGGYNY

SEQ ID NO: 3887 - protein, 3 aa, Artificial Sequence
  Description of Artificial Sequence: Synthetic peptide
EVS

SEQ ID NO: 3888 - protein, 6 aa, Artificial Sequence
  Description of Artificial Sequence: Synthetic peptide
YTSTSV

SEQ ID NO: 3889 - protein, 10 aa, Artificial Sequence
  Description of Artificial Sequence: Synthetic peptide
GGSISNYYWS

SEQ ID NO: 3890 - protein, 9 aa, Artificial Sequence
  Description of Artificial Sequence: Synthetic peptide
RIYSSGITN

SEQ ID NO: 3891 - protein, 10 aa, Artificial Sequence
  Description of Artificial Sequence: Synthetic peptide
IVGVKGAFAI

SEQ ID NO: 3892 - protein, 14 aa, Artificial Sequence
  Description of Artificial Sequence: Synthetic peptide
TGTSSDVGGYNYVS

SEQ ID NO: 3893 - protein, 7 aa, Artificial Sequence
  Description of Artificial Sequence: Synthetic peptide
EVSNRPS

SEQ ID NO: 3894 - protein, 9 aa, Artificial Sequence
  Description of Artificial Sequence: Synthetic peptide
SSYTSTSVV

SEQ ID NO: 3895 - protein, 6 aa, Artificial Sequence
  Description of Artificial Sequence: Synthetic peptide
SNYYWS

SEQ ID NO: 3896 - protein, 12 aa, Artificial Sequence
  Description of Artificial Sequence: Synthetic peptide
WIGRIYSSGITN

SEQ ID NO: 3897 - protein, 11 aa, Artificial Sequence
  Description of Artificial Sequence: Synthetic peptide
AGIVGVKGAFA

SEQ ID NO: 3898 - protein, 10 aa, Artificial Sequence
  Description of Artificial Sequence: Synthetic peptide
VGGYNYVSWY

SEQ ID NO: 3899 - protein, 10 aa, Artificial Sequence
  Description of Artificial Sequence: Synthetic peptide
LMIYEVSNRP

SEQ ID NO: 3900 - protein, 8 aa, Artificial Sequence
  Description of Artificial Sequence: Synthetic peptide
SSYTSTSV

SEQ ID NO: 3901 - protein, 8 aa, Artificial Sequence
  Description of Artificial Sequence: Synthetic peptide
GGSISNYY

SEQ ID NO: 3902 - protein, 7 aa, Artificial Sequence
  Description of Artificial Sequence: Synthetic peptide
IYSSGIT

SEQ ID NO: 3903 - protein, 12 aa, Artificial Sequence
  Description of Artificial Sequence: Synthetic peptide
AGIVGVKGAFAI

SEQ ID NO: 3904 - protein, 9 aa, Artificial Sequence
  Description of Artificial Sequence: Synthetic peptide
SSDVGGYNY

SEQ ID NO: 3905 - protein, 3 aa, Artificial Sequence
  Description of Artificial Sequence: Synthetic peptide
EVS

SEQ ID NO: 3906 - protein, 9 aa, Artificial Sequence
  Description of Artificial Sequence: Synthetic peptide
SSYTSTSVV

SEQ ID NO: 3907 - protein, 118 aa, Artificial Sequence; identical to SEQ ID NO: 3737
  Description of Artificial Sequence: Synthetic polypeptide

SEQ ID NO: 3908 - protein, 109 aa, Artificial Sequence; identical to SEQ ID NO: 3058
  Description of Artificial Sequence: Synthetic polypeptide

SEQ ID NO: 3909 - protein, 448 aa, Artificial Sequence; identical to SEQ ID NO: 3739
  Description of Artificial Sequence: Synthetic polypeptide

SEQ ID NO: 3910 - protein, 215 aa, Artificial Sequence; identical to SEQ ID NO: 3060
  Description of Artificial Sequence: Synthetic polypeptide

SEQ ID NO: 3911 - protein, 5 aa, Artificial Sequence
  Description of Artificial Sequence: Synthetic peptide
NYYWS

SEQ ID NO: 3912 - protein, 16 aa, Artificial Sequence
  Description of Artificial Sequence: Synthetic peptide
RIYSSGITNYNPSLKS

SEQ ID NO: 3913 - protein, 10 aa, Artificial Sequence
  Description of Artificial Sequence: Synthetic peptide
IVGVKGAFAI

SEQ ID NO: 3914 - protein, 14 aa, Artificial Sequence
  Description of Artificial Sequence: Synthetic peptide
TGTSSDVGGYNYVS

SEQ ID NO: 3915 - protein, 7 aa, Artificial Sequence
  Description of Artificial Sequence: Synthetic peptide
EVSNRPS

SEQ ID NO: 3916 - protein, 9 aa, Artificial Sequence
  Description of Artificial Sequence: Synthetic peptide
SSYTSTSVV

SEQ ID NO: 3917 - protein, 7 aa, Artificial Sequence
  Description of Artificial Sequence: Synthetic peptide
GGSISNY

SEQ ID NO: 3918 - protein, 5 aa, Artificial Sequence
  Description of Artificial Sequence: Synthetic peptide
YSSGI

SEQ ID NO: 3919 - protein, 9 aa, Artificial Sequence
  Description of Artificial Sequence: Synthetic peptide
IVGVKGAFA

SEQ ID NO: 3920 - protein, 10 aa, Artificial Sequence
  Description of Artificial Sequence: Synthetic peptide
TSSDVGGYNY

SEQ ID NO: 3921 - protein, 3 aa, Artificial Sequence
  Description of Artificial Sequence: Synthetic peptide
EVS

SEQ ID NO: 3922 - protein, 6 aa, Artificial Sequence
  Description of Artificial Sequence: Synthetic peptide
YTSTSV

SEQ ID NO: 3923 - protein, 10 aa, Artificial Sequence
  Description of Artificial Sequence: Synthetic peptide
GGSISNYYWS

SEQ ID NO: 3924 - protein, 9 aa, Artificial Sequence
  Description of Artificial Sequence: Synthetic peptide
RIYSSGITN

SEQ ID NO: 3925 - protein, 10 aa, Artificial Sequence
  Description of Artificial Sequence: Synthetic peptide
IVGVKGAFAI

SEQ ID NO: 3926 - protein, 14 aa, Artificial Sequence
  Description of Artificial Sequence: Synthetic peptide
TGTSSDVGGYNYVS

SEQ ID NO: 3927 - protein, 7 aa, Artificial Sequence
  Description of Artificial Sequence: Synthetic peptide
EVSNRPS

SEQ ID NO: 3928 - protein, 9 aa, Artificial Sequence
  Description of Artificial Sequence: Synthetic peptide
SSYTSTSVV

SEQ ID NO: 3929 - protein, 6 aa, Artificial Sequence
  Description of Artificial Sequence: Synthetic peptide
SNYYWS

SEQ ID NO: 3930 - protein, 12 aa, Artificial Sequence
  Description of Artificial Sequence: Synthetic peptide
WIGRIYSSGITN

SEQ ID NO: 3931 - protein, 11 aa, Artificial Sequence
  Description of Artificial Sequence: Synthetic peptide
AGIVGVKGAFA

SEQ ID NO: 3932 - protein, 10 aa, Artificial Sequence
  Description of Artificial Sequence: Synthetic peptide
VGGYNYVSWY

SEQ ID NO: 3933 - protein, 10 aa, Artificial Sequence
  Description of Artificial Sequence: Synthetic peptide
LMIYEVSNRP

SEQ ID NO: 3934 - protein, 8 aa, Artificial Sequence
  Description of Artificial Sequence: Synthetic peptide
SSYTSTSV

SEQ ID NO: 3935 - protein, 8 aa, Artificial Sequence
  Description of Artificial Sequence: Synthetic peptide
GGSISNYY

SEQ ID NO: 3936 - protein, 7 aa, Artificial Sequence
  Description of Artificial Sequence: Synthetic peptide
IYSSGIT

SEQ ID NO: 3937 - protein, 12 aa, Artificial Sequence
  Description of Artificial Sequence: Synthetic peptide
AGIVGVKGAFAI

SEQ ID NO: 3938 - protein, 9 aa, Artificial Sequence
  Description of Artificial Sequence: Synthetic peptide
SSDVGGYNY

SEQ ID NO: 3939 - protein, 3 aa, Artificial Sequence
  Description of Artificial Sequence: Synthetic peptide
EVS

SEQ ID NO: 3940 - protein, 9 aa, Artificial Sequence
  Description of Artificial Sequence: Synthetic peptide
SSYTSTSVV

SEQ ID NO: 3941 - protein, 118 aa, Artificial Sequence; identical to SEQ ID NO: 3329
  Description of Artificial Sequence: Synthetic polypeptide

SEQ ID NO: 3942 - protein, 109 aa, Artificial Sequence; identical to SEQ ID NO: 3058
  Description of Artificial Sequence: Synthetic polypeptide

SEQ ID NO: 3943 - protein, 448 aa, Artificial Sequence; identical to SEQ ID NO: 3331
  Description of Artificial Sequence: Synthetic polypeptide

SEQ ID NO: 3944 - protein, 215 aa, Artificial Sequence; identical to SEQ ID NO: 3060
  Description of Artificial Sequence: Synthetic polypeptide

SEQ ID NO: 3945 - protein, 5 aa, Artificial Sequence
  Description of Artificial Sequence: Synthetic peptide
NYYWS

SEQ ID NO: 3946 - protein, 16 aa, Artificial Sequence
  Description of Artificial Sequence: Synthetic peptide
RIYSSGITNYNPSLKS

SEQ ID NO: 3947 - protein, 10 aa, Artificial Sequence
  Description of Artificial Sequence: Synthetic peptide
IVGVKGAFAI

SEQ ID NO: 3948 - protein, 14 aa, Artificial Sequence
  Description of Artificial Sequence: Synthetic peptide
TGTSSDVGGYNYVS

SEQ ID NO: 3949 - protein, 7 aa, Artificial Sequence
  Description of Artificial Sequence: Synthetic peptide
EVSNRPS

SEQ ID NO: 3950 - protein, 9 aa, Artificial Sequence
  Description of Artificial Sequence: Synthetic peptide
SSYTSTSVV

SEQ ID NO: 3951 - protein, 7 aa, Artificial Sequence
  Description of Artificial Sequence: Synthetic peptide
GGSISNY

SEQ ID NO: 3952 - protein, 5 aa, Artificial Sequence
  Description of Artificial Sequence: Synthetic peptide
YSSGI

SEQ ID NO: 3953 - protein, 9 aa, Artificial Sequence
  Description of Artificial Sequence: Synthetic peptide
IVGVKGAFA

SEQ ID NO: 3954 - protein, 10 aa, Artificial Sequence
  Description of Artificial Sequence: Synthetic peptide
TSSDVGGYNY

SEQ ID NO: 3955 - protein, 3 aa, Artificial Sequence
  Description of Artificial Sequence: Synthetic peptide
EVS

SEQ ID NO: 3956 - protein, 6 aa, Artificial Sequence
  Description of Artificial Sequence: Synthetic peptide
YTSTSV

SEQ ID NO: 3957 - protein, 10 aa, Artificial Sequence
  Description of Artificial Sequence: Synthetic peptide
GGSISNYYWS

SEQ ID NO: 3958 - protein, 9 aa, Artificial Sequence
  Description of Artificial Sequence: Synthetic peptide
RIYSSGITN

SEQ ID NO: 3959 - protein, 10 aa, Artificial Sequence
  Description of Artificial Sequence: Synthetic peptide
IVGVKGAFAI

SEQ ID NO: 3960 - protein, 14 aa, Artificial Sequence
  Description of Artificial Sequence: Synthetic peptide
TGTSSDVGGYNYVS

SEQ ID NO: 3961 - protein, 7 aa, Artificial Sequence
  Description of Artificial Sequence: Synthetic peptide
EVSNRPS

SEQ ID NO: 3962 - protein, 9 aa, Artificial Sequence
  Description of Artificial Sequence: Synthetic peptide
SSYTSTSVV

SEQ ID NO: 3963 - protein, 6 aa, Artificial Sequence
  Description of Artificial Sequence: Synthetic peptide
SNYYWS

SEQ ID NO: 3964 - protein, 12 aa, Artificial Sequence
  Description of Artificial Sequence: Synthetic peptide
WIGRIYSSGITN

SEQ ID NO: 3965 - protein, 11 aa, Artificial Sequence
  Description of Artificial Sequence: Synthetic peptide
AGIVGVKGAFA

SEQ ID NO: 3966 - protein, 10 aa, Artificial Sequence
  Description of Artificial Sequence: Synthetic peptide
VGGYNYVSWY

SEQ ID NO: 3967 - protein, 10 aa, Artificial Sequence
  Description of Artificial Sequence: Synthetic peptide
LMIYEVSNRP

SEQ ID NO: 3968 - protein, 8 aa, Artificial Sequence
  Description of Artificial Sequence: Synthetic peptide
SSYTSTSV

SEQ ID NO: 3969 - protein, 8 aa, Artificial Sequence
  Description of Artificial Sequence: Synthetic peptide
GGSISNYY

SEQ ID NO: 3970 - protein, 7 aa, Artificial Sequence
  Description of Artificial Sequence: Synthetic peptide
IYSSGIT

SEQ ID NO: 3971 - protein, 12 aa, Artificial Sequence
  Description of Artificial Sequence: Synthetic peptide
AGIVGVKGAFAI

SEQ ID NO: 3972 - protein, 9 aa, Artificial Sequence
  Description of Artificial Sequence: Synthetic peptide
SSDVGGYNY

SEQ ID NO: 3973 - protein, 3 aa, Artificial Sequence
  Description of Artificial Sequence: Synthetic peptide
EVS

SEQ ID NO: 3974 - protein, 9 aa, Artificial Sequence
  Description of Artificial Sequence: Synthetic peptide
SSYTSTSVV

SEQ ID NO: 3975 - protein, 118 aa, Artificial Sequence; identical to SEQ ID NO: 3737
  Description of Artificial Sequence: Synthetic polypeptide

SEQ ID NO: 3976 - protein, 109 aa, Artificial Sequence
  Description of Artificial Sequence: Synthetic polypeptide
QLVLTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKLTVL

SEQ ID NO: 3977 - protein, 448 aa, Artificial Sequence; identical to SEQ ID NO: 3739
  Description of Artificial Sequence: Synthetic polypeptide

SEQ ID NO: 3978 - protein, 215 aa, Artificial Sequence
  Description of Artificial Sequence: Synthetic polypeptide
QLVLTQPASVSGSPGQSITISCTGTSSDVGGYNYVSWYQQHPGKAPKLMIYEVSNRPSGVSNRFSGSKSGNTASLTISGLQAEDEADYYCSSYTSTSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3979 - protein, 5 aa, Artificial Sequence
  Description of Artificial Sequence: Synthetic peptide
NHGMS

SEQ ID NO: 3980 - protein, 17 aa, Artificial Sequence
  Description of Artificial Sequence: Synthetic peptide
SITRGGDTTYYPDNVKG

SEQ ID NO: 3981 - protein, 11 aa, Artificial Sequence
  Description of Artificial Sequence: Synthetic peptide
GPLTVGYAMDY

SEQ ID NO: 3982 - protein, 14 aa, Artificial Sequence
  Description of Artificial Sequence: Synthetic peptide
TGTSSDVGGYNYVS

SEQ ID NO: 3983 - protein, 7 aa, Artificial Sequence
  Description of Artificial Sequence: Synthetic peptide
EVSKRPS

SEQ ID NO: 3984 - protein, 11 aa, Artificial Sequence
  Description of Artificial Sequence: Synthetic peptide
NSYAGSNNFEV

SEQ ID NO: 3985 - protein, 7 aa, Artificial Sequence
  Description of Artificial Sequence: Synthetic peptide
GFTFSNH

SEQ ID NO: 3986 - protein, 6 aa, Artificial Sequence
  Description of Artificial Sequence: Synthetic peptide
TRGGDT

SEQ ID NO: 3987 - protein, 10 aa, Artificial Sequence
  Description of Artificial Sequence: Synthetic peptide
GPLTVGYAMD

SEQ ID NO: 3988 - protein, 10 aa, Artificial Sequence
  Description of Artificial Sequence: Synthetic peptide
TSSDVGGYNY

SEQ ID NO: 3989 - protein, 3 aa, Artificial Sequence
  Description of Artificial Sequence: Synthetic peptide
EVS

SEQ ID NO: 3990 - protein, 8 aa, Artificial Sequence
  Description of Artificial Sequence: Synthetic peptide
YAGSNNFE

SEQ ID NO: 3991 - protein, 10 aa, Artificial Sequence
  Description of Artificial Sequence: Synthetic peptide
GFTFSNHGMS

SEQ ID NO: 3992 - protein, 10 aa, Artificial Sequence
  Description of Artificial Sequence: Synthetic peptide
SITRGGDTTY

SEQ ID NO: 3993 - protein, 11 aa, Artificial Sequence
  Description of Artificial Sequence: Synthetic peptide
GPLTVGYAMDY

SEQ ID NO: 3994 - protein, 14 aa, Artificial Sequence
  Description of Artificial Sequence: Synthetic peptide
TGTSSDVGGYNYVS

SEQ ID NO: 3995 - protein, 7 aa, Artificial Sequence
  Description of Artificial Sequence: Synthetic peptide
EVSKRPS

SEQ ID NO: 3996 - protein, 11 aa, Artificial Sequence
  Description of Artificial Sequence: Synthetic peptide
NSYAGSNNFEV

SEQ ID NO: 3997 - protein, 6 aa, Artificial Sequence
  Description of Artificial Sequence: Synthetic peptide
SNHGMS

SEQ ID NO: 3998 - protein, 13 aa, Artificial Sequence
  Description of Artificial Sequence: Synthetic peptide
WVASITRGGDTTY

SEQ ID NO: 3999 - protein, 12 aa, Artificial Sequence
  Description of Artificial Sequence: Synthetic peptide
TRGPLTVGYAMD

SEQ ID NO: 4000 - protein, 10 aa, Artificial Sequence
  Description of Artificial Sequence: Synthetic peptide
VGGYNYVSWY

SEQ ID NO: 4001 - protein, 10 aa, Artificial Sequence
  Description of Artificial Sequence: Synthetic peptide
LMIYEVSKRP

SEQ ID NO: 4002 - protein, 10 aa, Artificial Sequence
  Description of Artificial Sequence: Synthetic peptide
NSYAGSNNFE

SEQ ID NO: 4003 - protein, 8 aa, Artificial Sequence
  Description of Artificial Sequence: Synthetic peptide
GFTFSNHG

SEQ ID NO: 4004 - protein, 8 aa, Artificial Sequence
  Description of Artificial Sequence: Synthetic peptide
ITRGGDTT

SEQ ID NO: 4005 - protein, 13 aa, Artificial Sequence
  Description of Artificial Sequence: Synthetic peptide
TRGPLTVGYAMDY

SEQ ID NO: 4006 - protein, 9 aa, Artificial Sequence
  Description of Artificial Sequence: Synthetic peptide
SSDVGGYNY

SEQ ID NO: 4007 - protein, 3 aa, Artificial Sequence
  Description of Artificial Sequence: Synthetic peptide
EVS

SEQ ID NO: 4008 - protein, 11 aa, Artificial Sequence
  Description of Artificial Sequence: Synthetic peptide
NSYAGSNNFEV

SEQ ID NO: 4009 - protein, 120 aa, Artificial Sequence
  Description of Artificial Sequence: Synthetic polypeptide
EVQLVQSGGGLVKPGASLKLSCAASGFTFSNHGMSWVRQTSDKRLEWVASITRGGDTTYYPDNVKGRFTISRENAKNTLYLQMSSLKSDDTALYYCTRGPLTVGYAMDYWGQGTTVTVSS

SEQ ID NO: 4010 - protein, 111 aa, Artificial Sequence
  Description of Artificial Sequence: Synthetic polypeptide
QSVVTQPPSASGSPGQSVTISCTGTSSDVGGYNYVSWYQQHPGKAPKLMIYEVSKRPSGVPDRFSGSKSGNTASLTVSGLQAEDEADYYCNSYAGSNNFEVFGGGTKVTVL

SEQ ID NO: 4011 - protein, 450 aa, Artificial Sequence
  Description of Artificial Sequence: Synthetic polypeptide
EVQLVQSGGGLVKPGASLKLSCAASGFTFSNHGMSWVRQTSDKRLEWVASITRGGDTTYYPDNVKGRFTISRENAKNTLYLQMSSLKSDDTALYYCTRGPLTVGYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4012 - protein, 217 aa, Artificial Sequence
  Description of Artificial Sequence: Synthetic polypeptide
QSVVTQPPSASGSPGQSVTISCTGTSSDVGGYNYVSWYQQHPGKAPKLMIYEVSKRPSGVPDRFSGSKSGNTASLTVSGLQAEDEADYYCNSYAGSNNFEVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4013 - protein, 5 aa, Artificial Sequence
  Description of Artificial Sequence: Synthetic peptide
NYYWS

SEQ ID NO: 4014 - protein, 16 aa, Artificial Sequence
  Description of Artificial Sequence: Synthetic peptide
RIYSSGITNYNPSLKS

SEQ ID NO: 4015 - protein, 10 aa, Artificial Sequence
  Description of Artificial Sequence: Synthetic peptide
IVGVKGAFAI

SEQ ID NO: 4016 - protein, 14 aa, Artificial Sequence
  Description of Artificial Sequence: Synthetic peptide
TGTSSDVGGYNYVS

SEQ ID NO: 4017 - protein, 7 aa, Artificial Sequence
  Description of Artificial Sequence: Synthetic peptide
EVSNRPS

SEQ ID NO: 4018 - protein, 9 aa, Artificial Sequence
  Description of Artificial Sequence: Synthetic peptide
SSYTSTSVV

SEQ ID NO: 4019 - protein, 7 aa, Artificial Sequence
  Description of Artificial Sequence: Synthetic peptide
GGSISNY

SEQ ID NO: 4020 - protein, 5 aa, Artificial Sequence
  Description of Artificial Sequence: Synthetic peptide
YSSGI

SEQ ID NO: 4021 - protein, 9 aa, Artificial Sequence
  Description of Artificial Sequence: Synthetic peptide
IVGVKGAFA

SEQ ID NO: 4022 - protein, 10 aa, Artificial Sequence
  Description of Artificial Sequence: Synthetic peptide
TSSDVGGYNY

SEQ ID NO: 4023 - protein, 3 aa, Artificial Sequence
  Description of Artificial Sequence: Synthetic peptide
EVS

SEQ ID NO: 4024 - protein, 6 aa, Artificial Sequence
  Description of Artificial Sequence: Synthetic peptide
YTSTSV

SEQ ID NO: 4025 - protein, 10 aa, Artificial Sequence
  Description of Artificial Sequence: Synthetic peptide
GGSISNYYWS

SEQ ID NO: 4026 - protein, 9 aa, Artificial Sequence
  Description of Artificial Sequence: Synthetic peptide
RIYSSGITN

SEQ ID NO: 4027 - protein, 10 aa, Artificial Sequence
  Description of Artificial Sequence: Synthetic peptide
IVGVKGAFAI

SEQ ID NO: 4028 - protein, 14 aa, Artificial Sequence
  Description of Artificial Sequence: Synthetic peptide
TGTSSDVGGYNYVS

SEQ ID NO: 4029 - protein, 7 aa, Artificial Sequence
  Description of Artificial Sequence: Synthetic peptide
EVSNRPS

SEQ ID NO: 4030 - protein, 9 aa, Artificial Sequence
  Description of Artificial Sequence: Synthetic peptide
SSYTSTSVV

SEQ ID NO: 4031 - protein, 6 aa, Artificial Sequence
  Description of Artificial Sequence: Synthetic peptide
SNYYWS

SEQ ID NO: 4032 - protein, 12 aa, Artificial Sequence
  Description of Artificial Sequence: Synthetic peptide
WIGRIYSSGITN

SEQ ID NO: 4033 - protein, 11 aa, Artificial Sequence
  Description of Artificial Sequence: Synthetic peptide
AGIVGVKGAFA

SEQ ID NO: 4034 - protein, 10 aa, Artificial Sequence
  Description of Artificial Sequence: Synthetic peptide
VGGYNYVSWY

SEQ ID NO: 4035 - protein, 10 aa, Artificial Sequence
  Description of Artificial Sequence: Synthetic peptide
LMIYEVSNRP

SEQ ID NO: 4036 - protein, 8 aa, Artificial Sequence
  Description of Artificial Sequence: Synthetic peptide
SSYTSTSV

SEQ ID NO: 4037 - protein, 8 aa, Artificial Sequence
  Description of Artificial Sequence: Synthetic peptide
GGSISNYY

SEQ ID NO: 4038 - protein, 7 aa, Artificial Sequence
  Description of Artificial Sequence: Synthetic peptide
IYSSGIT

SEQ ID NO: 4039 - protein, 12 aa, Artificial Sequence
  Description of Artificial Sequence: Synthetic peptide
AGIVGVKGAFAI

SEQ ID NO: 4040 - protein, 9 aa, Artificial Sequence
  Description of Artificial Sequence: Synthetic peptide
SSDVGGYNY

SEQ ID NO: 4041 - protein, 3 aa, Artificial Sequence
  Description of Artificial Sequence: Synthetic peptide
EVS

SEQ ID NO: 4042 - protein, 9 aa, Artificial Sequence
  Description of Artificial Sequence: Synthetic peptide
SSYTSTSVV

SEQ ID NO: 4043 - protein, 118 aa, Artificial Sequence; identical to SEQ ID NO: 3635
  Description of Artificial Sequence: Synthetic polypeptide

SEQ ID NO: 4044 - protein, 109 aa, Artificial Sequence; identical to SEQ ID NO: 3364
  Description of Artificial Sequence: Synthetic polypeptide

SEQ ID NO: 4045 - protein, 448 aa, Artificial Sequence; identical to SEQ ID NO: 3637
  Description of Artificial Sequence: Synthetic polypeptide

SEQ ID NO: 4046 - protein, 215 aa, Artificial Sequence; identical to SEQ ID NO: 3366
  Description of Artificial Sequence: Synthetic polypeptide

SEQ ID NO: 4047 - protein, 5 aa, Artificial Sequence
  Description of Artificial Sequence: Synthetic peptide
SYYWS

SEQ ID NO: 4048 - protein, 16 aa, Artificial Sequence
  Description of Artificial Sequence: Synthetic peptide
RIHTIGSINYNPSLKS

SEQ ID NO: 4049 - protein, 14 aa, Artificial Sequence
  Description of Artificial Sequence: Synthetic peptide
EGVGATNYYYGMAV

SEQ ID NO: 4050 - protein, 16 aa, Artificial Sequence
  Description of Artificial Sequence: Synthetic peptide
RSSQSLLHSNGYNYLD

SEQ ID NO: 4051 - protein, 7 aa, Artificial Sequence
  Description of Artificial Sequence: Synthetic peptide
LGSNRAS

SEQ ID NO: 4052 - protein, 9 aa, Artificial Sequence
  Description of Artificial Sequence: Synthetic peptide
MQALQTPYT

SEQ ID NO: 4053 - protein, 7 aa, Artificial Sequence
  Description of Artificial Sequence: Synthetic peptide
GGSISSY

SEQ ID NO: 4054 - protein, 5 aa, Artificial Sequence
  Description of Artificial Sequence: Synthetic peptide
HTIGS

SEQ ID NO: 4055 - protein, 13 aa, Artificial Sequence
  Description of Artificial Sequence: Synthetic peptide
EGVGATNYYYGMA

SEQ ID NO: 4056 - protein, 12 aa, Artificial Sequence
  Description of Artificial Sequence: Synthetic peptide
SQSLLHSNGYNY

SEQ ID NO: 4057 - protein, 3 aa, Artificial Sequence
  Description of Artificial Sequence: Synthetic peptide
LGS

SEQ ID NO: 4058 - protein, 6 aa, Artificial Sequence
  Description of Artificial Sequence: Synthetic peptide
ALQTPY

SEQ ID NO: 4059 - protein, 10 aa, Artificial Sequence
  Description of Artificial Sequence: Synthetic peptide
GGSISSYYWS

SEQ ID NO: 4060 - protein, 9 aa, Artificial Sequence
  Description of Artificial Sequence: Synthetic peptide
RIHTIGSIN

SEQ ID NO: 4061 - protein, 14 aa, Artificial Sequence
  Description of Artificial Sequence: Synthetic peptide
EGVGATNYYYGMAV

SEQ ID NO: 4062 - protein, 16 aa, Artificial Sequence
  Description of Artificial Sequence: Synthetic peptide
RSSQSLLHSNGYNYLD

SEQ ID NO: 4063 - protein, 7 aa, Artificial Sequence
  Description of Artificial Sequence: Synthetic peptide
LGSNRAS

SEQ ID NO: 4064 - protein, 9 aa, Artificial Sequence
  Description of Artificial Sequence: Synthetic peptide
MQALQTPYT

SEQ ID NO: 4065 - protein, 6 aa, Artificial Sequence
  Description of Artificial Sequence: Synthetic peptide
SSYYWS

SEQ ID NO: 4066 - protein, 12 aa, Artificial Sequence
  Description of Artificial Sequence: Synthetic peptide
WIGRIHTIGSIN

SEQ ID NO: 4067 - protein, 15 aa, Artificial Sequence
  Description of Artificial Sequence: Synthetic peptide
AMEGVGATNYYYGMA

SEQ ID NO: 4068 - protein, 12 aa, Artificial Sequence
  Description of Artificial Sequence: Synthetic peptide
LHSNGYNYLDWY

SEQ ID NO: 4069 - protein, 10 aa, Artificial Sequence
  Description of Artificial Sequence: Synthetic peptide
LLIYLGSNRA

SEQ ID NO: 4070 - protein, 8 aa, Artificial Sequence
  Description of Artificial Sequence: Synthetic peptide
MQALQTPY

SEQ ID NO: 4071 - protein, 8 aa, Artificial Sequence
  Description of Artificial Sequence: Synthetic peptide
GGSISSYY

SEQ ID NO: 4072 - protein, 7 aa, Artificial Sequence
  Description of Artificial Sequence: Synthetic peptide
IHTIGSI

SEQ ID NO: 4073 - protein, 16 aa, Artificial Sequence
  Description of Artificial Sequence: Synthetic peptide
AMEGVGATNYYYGMAV

SEQ ID NO: 4074 - protein, 11 aa, Artificial Sequence
  Description of Artificial Sequence: Synthetic peptide
QSLLHSNGYNY

SEQ ID NO: 4075 - protein, 3 aa, Artificial Sequence
  Description of Artificial Sequence: Synthetic peptide
LGS

SEQ ID NO: 4076 - protein, 9 aa, Artificial Sequence
  Description of Artificial Sequence: Synthetic peptide
MQALQTPYT

SEQ ID NO: 4077 - protein, 122 aa, Artificial Sequence
  Description of Artificial Sequence: Synthetic polypeptide
QVQLQESGPGLVKPSETLSLTCTVSGGSISSYYWSWIRQPAGKGLEWIGRIHTIGSINYNPSLKSRVTMSVDTSKNQFSLKLSSVTAADTAVYYCAMEGVGATNYYYGMAVWGRGTMVTVSS

SEQ ID NO: 4078 - protein, 112 aa, Artificial Sequence
  Description of Artificial Sequence: Synthetic polypeptide
DIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 4079 - protein, 452 aa, Artificial Sequence
  Description of Artificial Sequence: Synthetic polypeptide
QVQLQESGPGLVKPSETLSLTCTVSGGSISSYYWSWIRQPAGKGLEWIGRIHTIGSINYNPSLKSRVTMSVDTSKNQFSLKLSSVTAADTAVYYCAMEGVGATNYYYGMAVWGRGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4080 - protein, 219 aa, Artificial Sequence
  Description of Artificial Sequence: Synthetic polypeptide
DIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4081 - protein, 5 aa, Artificial Sequence
  Description of Artificial Sequence: Synthetic peptide
TYWMH

SEQ ID NO: 4082 - protein, 17 aa, Artificial Sequence
  Description of Artificial Sequence: Synthetic peptide
LIDPSDSETRLNQKFKD

SEQ ID NO: 4083 - protein, 6 aa, Artificial Sequence
  Description of Artificial Sequence: Synthetic peptide
NRWLLG

SEQ ID NO: 4084 - protein, 16 aa, Artificial Sequence
  Description of Artificial Sequence: Synthetic peptide
RSSQSLVHSDGNTYLS

SEQ ID NO: 4085 - protein, 7 aa, Artificial Sequence
  Description of Artificial Sequence: Synthetic peptide
KISNRFS

SEQ ID NO: 4086 - protein, 9 aa, Artificial Sequence
  Description of Artificial Sequence: Synthetic peptide
VQTREFPLT

SEQ ID NO: 4087 - protein, 7 aa, Artificial Sequence
  Description of Artificial Sequence: Synthetic peptide
GYSFTTY

SEQ ID NO: 4088 - protein, 6 aa, Artificial Sequence
  Description of Artificial Sequence: Synthetic peptide
DPSDSE

SEQ ID NO: 4089 - protein, 5 aa, Artificial Sequence
  Description of Artificial Sequence: Synthetic peptide
NRWLL

SEQ ID NO: 4090 - protein, 12 aa, Artificial Sequence
  Description of Artificial Sequence: Synthetic peptide
SQSLVHSDGNTY

SEQ ID NO: 4091 - protein, 3 aa, Artificial Sequence
  Description of Artificial Sequence: Synthetic peptide
KIS

SEQ ID NO: 4092 - protein, 6 aa, Artificial Sequence
  Description of Artificial Sequence: Synthetic peptide
TREFPL

SEQ ID NO: 4093 - protein, 10 aa, Artificial Sequence
  Description of Artificial Sequence: Synthetic peptide
GYSFTTYWMH

SEQ ID NO: 4094 - protein, 10 aa, Artificial Sequence
  Description of Artificial Sequence: Synthetic peptide
LIDPSDSETR

SEQ ID NO: 4095 - protein, 6 aa, Artificial Sequence
  Description of Artificial Sequence: Synthetic peptide
NRWLLG

SEQ ID NO: 4096 - protein, 16 aa, Artificial Sequence
  Description of Artificial Sequence: Synthetic peptide
RSSQSLVHSDGNTYLS

SEQ ID NO: 4097 - protein, 7 aa, Artificial Sequence
  Description of Artificial Sequence: Synthetic peptide
KISNRFS

SEQ ID NO: 4098 - protein, 9 aa, Artificial Sequence
  Description of Artificial Sequence: Synthetic peptide
VQTREFPLT

SEQ ID NO: 4099 - protein, 6 aa, Artificial Sequence
  Description of Artificial Sequence: Synthetic peptide
TTYWMH

SEQ ID NO: 4100 - protein, 13 aa, Artificial Sequence
  Description of Artificial Sequence: Synthetic peptide
WIGLIDPSDSETR

SEQ ID NO: 4101 - protein, 7 aa, Artificial Sequence
  Description of Artificial Sequence: Synthetic peptide
ASNRWLL

SEQ ID NO: 4102 - protein, 12 aa, Artificial Sequence
  Description of Artificial Sequence: Synthetic peptide
VHSDGNTYLSWL

SEQ ID NO: 4103 - protein, 10 aa, Artificial Sequence
  Description of Artificial Sequence: Synthetic peptide
LLIYKISNRF

SEQ ID NO: 4104 - protein, 8 aa, Artificial Sequence
  Description of Artificial Sequence: Synthetic peptide
VQTREFPL

SEQ ID NO: 4105 - protein, 8 aa, Artificial Sequence
  Description of Artificial Sequence: Synthetic peptide
GYSFTTYW

SEQ ID NO: 4106 - protein, 8 aa, Artificial Sequence
  Description of Artificial Sequence: Synthetic peptide
IDPSDSET

SEQ ID NO: 4107 - protein, 8 aa, Artificial Sequence
  Description of Artificial Sequence: Synthetic peptide
ASNRWLLG

SEQ ID NO: 4108 - protein, 11 aa, Artificial Sequence
  Description of Artificial Sequence: Synthetic peptide
QSLVHSDGNTY

SEQ ID NO: 4109 - protein, 3 aa, Artificial Sequence
  Description of Artificial Sequence: Synthetic peptide
KIS

SEQ ID NO: 4110 - protein, 9 aa, Artificial Sequence
  Description of Artificial Sequence: Synthetic peptide
VQTREFPLT

SEQ ID NO: 4111 - protein, 115 aa, Artificial Sequence
  Description of Artificial Sequence: Synthetic polypeptide
QVQLQESGPQLVRPGASVKISCKASGYSFTTYWMHWVKQRPGQGLEWIGLIDPSDSETRLNQKFKDKATLTVDKSSSTAYMRLSSPTSEDSAVYYCASNRWLLGWGQGTMVTVSS

SEQ ID NO: 4112 - protein, 112 aa, Artificial Sequence
  Description of Artificial Sequence: Synthetic polypeptide
EIVLTQTPLSSPVTLGQPASISCRSSQSLVHSDGNTYLSWLHQRPGQPPRLLIYKISNRFSGVPDRFSGSGAGTDFTLKISRVETEDVGVYYCVQTREFPLTFGGGTKVEIK

SEQ ID NO: 4113 - protein, 445 aa, Artificial Sequence
  Description of Artificial Sequence: Synthetic polypeptide
QVQLQESGPQLVRPGASVKISCKASGYSFTTYWMHWVKQRPGQGLEWIGLIDPSDSETRLNQKFKDKATLTVDKSSSTAYMRLSSPTSEDSAVYYCASNRWLLGWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4114 - protein, 219 aa, Artificial Sequence
  Description of Artificial Sequence: Synthetic polypeptide
EIVLTQTPLSSPVTLGQPASISCRSSQSLVHSDGNTYLSWLHQRPGQPPRLLIYKISNRFSGVPDRFSGSGAGTDFTLKISRVETEDVGVYYCVQTREFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4115 - protein, 7 aa, Artificial Sequence
  Description of Artificial Sequence: Synthetic peptide
SNRAAWN

SEQ ID NO: 4116 - protein, 18 aa, Artificial Sequence
  Description of Artificial Sequence: Synthetic peptide
RTYYRSKWYNEYAASVKS

SEQ ID NO: 4117 - protein, 11 aa, Artificial Sequence
  Description of Artificial Sequence: Synthetic peptide
DLWELREACDI

SEQ ID NO: 4118 - protein, 11 aa, Artificial Sequence
  Description of Artificial Sequence: Synthetic peptide
RASQGISSYLA

SEQ ID NO: 4119 - protein, 7 aa, Artificial Sequence
  Description of Artificial Sequence: Synthetic peptide
VASTLQS

SEQ ID NO: 4120 - protein, 9 aa, Artificial Sequence
  Description of Artificial Sequence: Synthetic peptide
QQLNSYPFT

SEQ ID NO: 4121 - protein, 9 aa, Artificial Sequence
  Description of Artificial Sequence: Synthetic peptide
GDSVSSNRA

SEQ ID NO: 4122 - protein, 7 aa, Artificial Sequence
  Description of Artificial Sequence: Synthetic peptide
YYRSKWY

SEQ ID NO: 4123 - protein, 10 aa, Artificial Sequence
  Description of Artificial Sequence: Synthetic peptide
DLWELREACD

SEQ ID NO: 4124 - protein, 7 aa, Artificial Sequence
  Description of Artificial Sequence: Synthetic peptide
SQGISSY

SEQ ID NO: 4125 - protein, 3 aa, Artificial Sequence
  Description of Artificial Sequence: Synthetic peptide
VAS

SEQ ID NO: 4126 - protein, 6 aa, Artificial Sequence
  Description of Artificial Sequence: Synthetic peptide
LNSYPF

SEQ ID NO: 4127 - protein, 12 aa, Artificial Sequence
  Description of Artificial Sequence: Synthetic peptide
GDSVSSNRAAWN

SEQ ID NO: 4128 - protein, 11 aa, Artificial Sequence
  Description of Artificial Sequence: Synthetic peptide
RTYYRSKWYNE

SEQ ID NO: 4129 - protein, 11 aa, Artificial Sequence
  Description of Artificial Sequence: Synthetic peptide
DLWELREACDI

SEQ ID NO: 4130 - protein, 11 aa, Artificial Sequence
  Description of Artificial Sequence: Synthetic peptide
RASQGISSYLA

SEQ ID NO: 4131 - protein, 7 aa, Artificial Sequence
  Description of Artificial Sequence: Synthetic peptide
VASTLQS

SEQ ID NO: 4132 - protein, 9 aa, Artificial Sequence
  Description of Artificial Sequence: Synthetic peptide
QQLNSYPFT

SEQ ID NO: 4133 - protein, 8 aa, Artificial Sequence
  Description of Artificial Sequence: Synthetic peptide
SSNRAAWN

SEQ ID NO: 4134 - protein, 14 aa, Artificial Sequence
  Description of Artificial Sequence: Synthetic peptide
WLGRTYYRSKWYNE

SEQ ID NO: 4135 - protein, 12 aa, Artificial Sequence
  Description of Artificial Sequence: Synthetic peptide
ARDLWELREACD

SEQ ID NO: 4136 - protein, 7 aa, Artificial Sequence
  Description of Artificial Sequence: Synthetic peptide
SSYLAWY

SEQ ID NO: 4137 - protein, 10 aa, Artificial Sequence
  Description of Artificial Sequence: Synthetic peptide
LLIYVASTLQ

SEQ ID NO: 4138 - protein, 8 aa, Artificial Sequence
  Description of Artificial Sequence: Synthetic peptide
QQLNSYPF

SEQ ID NO: 4139 - protein, 10 aa, Artificial Sequence
  Description of Artificial Sequence: Synthetic peptide
GDSVSSNRAA

SEQ ID NO: 4140 - protein, 9 aa, Artificial Sequence
  Description of Artificial Sequence: Synthetic peptide
TYYRSKWYN

SEQ ID NO: 4141 - protein, 13 aa, Artificial Sequence
  Description of Artificial Sequence: Synthetic peptide
ARDLWELREACDI

SEQ ID NO: 4142 - protein, 6 aa, Artificial Sequence
  Description of Artificial Sequence: Synthetic peptide
QGISSY

SEQ ID NO: 4143 - protein, 3 aa, Artificial Sequence
  Description of Artificial Sequence: Synthetic peptide
VAS

SEQ ID NO: 4144 - protein, 9 aa, Artificial Sequence
  Description of Artificial Sequence: Synthetic peptide
QQLNSYPFT

SEQ ID NO: 4145 - protein, 123 aa, Artificial Sequence
  Description of Artificial Sequence: Synthetic polypeptide
QVQLQQSGPGLVKPSQTLSLTCAISGDSVSSNRAAWNWIRQSPSKGLEWLGRTYYRSKWYNEYAASVKSRMSINPDTSKNQFSLQLNSVTPEDTALYYCARDLWELREACDIWGQGTMVTVSS

SEQ ID NO: 4146 - protein, 107 aa, Artificial Sequence
  Description of Artificial Sequence: Synthetic polypeptide
DIVMTQSPSFLSTFVGDRVTITCRASQGISSYLAWYQQKPGKVPKLLIYVASTLQSGVPSRFSGSGSGTEFTLTISSLQPEDFATYYCQQLNSYPFTFGPGTKVDIK

SEQ ID NO: 4147 - protein, 453 aa, Artificial Sequence
  Description of Artificial Sequence: Synthetic polypeptide
QVQLQQSGPGLVKPSQTLSLTCAISGDSVSSNRAAWNWIRQSPSKGLEWLGRTYYRSKWYNEYAASVKSRMSINPDTSKNQFSLQLNSVTPEDTALYYCARDLWELREACDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4148 - protein, 214 aa, Artificial Sequence
  Description of Artificial Sequence: Synthetic polypeptide
DIVMTQSPSFLSTFVGDRVTITCRASQGISSYLAWYQQKPGKVPKLLIYVASTLQSGVPSRFSGSGSGTEFTLTISSLQPEDFATYYCQQLNSYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4149 - protein, 5 aa, Artificial Sequence
  Description of Artificial Sequence: Synthetic peptide
NYDMN

SEQ ID NO: 4150 - protein, 17 aa, Artificial Sequence
  Description of Artificial Sequence: Synthetic peptide
SISSSSSYIYYADSVKG

SEQ ID NO: 4151 - protein, 15 aa, Artificial Sequence
  Description of Artificial Sequence: Synthetic peptide
DVGVTTDYYYYGMDV

SEQ ID NO: 4152 - protein, 12 aa, Artificial Sequence
  Description of Artificial Sequence: Synthetic peptide
RASQSVASSYLA

SEQ ID NO: 4153 - protein, 7 aa, Artificial Sequence
  Description of Artificial Sequence: Synthetic peptide
GASSRAT

SEQ ID NO: 4154 - protein, 10 aa, Artificial Sequence
  Description of Artificial Sequence: Synthetic peptide
QQYGSSPPYT

SEQ ID NO: 4155 - protein, 7 aa, Artificial Sequence
  Description of Artificial Sequence: Synthetic peptide
GFTFSNY

SEQ ID NO: 4156 - protein, 6 aa, Artificial Sequence
  Description of Artificial Sequence: Synthetic peptide
SSSSSY

SEQ ID NO: 4157 - protein, 14 aa, Artificial Sequence
  Description of Artificial Sequence: Synthetic peptide
DVGVTTDYYYYGMD

SEQ ID NO: 4158 - protein, 8 aa, Artificial Sequence
  Description of Artificial Sequence: Synthetic peptide
SQSVASSY

SEQ ID NO: 4159 - protein, 3 aa, Artificial Sequence
  Description of Artificial Sequence: Synthetic peptide
GAS

SEQ ID NO: 4160 - protein, 7 aa, Artificial Sequence
  Description of Artificial Sequence: Synthetic peptide
YGSSPPY

SEQ ID NO: 4161 - protein, 10 aa, Artificial Sequence
  Description of Artificial Sequence: Synthetic peptide
GFTFSNYDMN

SEQ ID NO: 4162 - protein, 10 aa, Artificial Sequence
  Description of Artificial Sequence: Synthetic peptide
SISSSSSYIY

SEQ ID NO: 4163 - protein, 15 aa, Artificial Sequence
  Description of Artificial Sequence: Synthetic peptide
DVGVTTDYYYYGMDV

SEQ ID NO: 4164 - protein, 12 aa, Artificial Sequence
  Description of Artificial Sequence: Synthetic peptide
RASQSVASSYLA

SEQ ID NO: 4165 - protein, 7 aa, Artificial Sequence
  Description of Artificial Sequence: Synthetic peptide
GASSRAT

SEQ ID NO: 4166 - protein, 10 aa, Artificial Sequence
  Description of Artificial Sequence: Synthetic peptide
QQYGSSPPYT

SEQ ID NO: 4167 - protein, 6 aa, Artificial Sequence
  Description of Artificial Sequence: Synthetic peptide
SNYDMN

SEQ ID NO: 4168 - protein, 13 aa, Artificial Sequence
  Description of Artificial Sequence: Synthetic peptide
WVSSISSSSSYIY

SEQ ID NO: 4169 - protein, 16 aa, Artificial Sequence
  Description of Artificial Sequence: Synthetic peptide
ARDVGVTTDYYYYGMD

SEQ ID NO: 4170 - protein, 8 aa, Artificial Sequence
  Description of Artificial Sequence: Synthetic peptide
ASSYLAWY

SEQ ID NO: 4171 - protein, 10 aa, Artificial Sequence
  Description of Artificial Sequence: Synthetic peptide
LLIYGASSRA

SEQ ID NO: 4172 - protein, 9 aa, Artificial Sequence
  Description of Artificial Sequence: Synthetic peptide
QQYGSSPPY

SEQ ID NO: 4173 - protein, 8 aa, Artificial Sequence
  Description of Artificial Sequence: Synthetic peptide
GFTFSNYD

SEQ ID NO: 4174 - protein, 8 aa, Artificial Sequence
  Description of Artificial Sequence: Synthetic peptide
ISSSSSYI

SEQ ID NO: 4175 - protein, 17 aa, Artificial Sequence
  Description of Artificial Sequence: Synthetic peptide
ARDVGVTTDYYYYGMDV

SEQ ID NO: 4176 - protein, 7 aa, Artificial Sequence
  Description of Artificial Sequence: Synthetic peptide
QSVASSY

SEQ ID NO: 4177 - protein, 3 aa, Artificial Sequence
  Description of Artificial Sequence: Synthetic peptide
GAS

SEQ ID NO: 4178 - protein, 10 aa, Artificial Sequence
  Description of Artificial Sequence: Synthetic peptide
QQYGSSPPYT

SEQ ID NO: 4179 - protein, 124 aa, Artificial Sequence; identical to SEQ ID NO: 201
  Description of Artificial Sequence: Synthetic polypeptide

SEQ ID NO: 4180 - protein, 109 aa, Artificial Sequence
  Description of Artificial Sequence: Synthetic polypeptide
ETTLTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTKVDIK

SEQ ID NO: 4181 - protein, 454 aa, Artificial Sequence; identical to SEQ ID NO: 203
  Description of Artificial Sequence: Synthetic polypeptide

SEQ ID NO: 4182 - protein, 216 aa, Artificial Sequence
  Description of Artificial Sequence: Synthetic polypeptide
ETTLTQSPGTLSLSPGDRATLSCRASQSVASSYLAWYQQKPGQSPRLLIYGASSRATGIPDRFSGSGSGTDFTLTISRLEPEDFAVYYCQQYGSSPPYTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4183 - protein, 7 aa, Artificial Sequence
  Description of Artificial Sequence: Synthetic peptide
TIGVGVG

SEQ ID NO: 4184 - protein, 16 aa, Artificial Sequence
  Description of Artificial Sequence: Synthetic peptide
LIYWNDDKRYNPSLKS

SEQ ID NO: 4185 - protein, 10 aa, Artificial Sequence
  Description of Artificial Sequence: Synthetic peptide
SHDWVHAFDI

SEQ ID NO: 4186 - protein, 11 aa, Artificial Sequence
  Description of Artificial Sequence: Synthetic peptide
QASQDISHYLN

SEQ ID NO: 4187 - protein, 7 aa, Artificial Sequence
  Description of Artificial Sequence: Synthetic peptide
DASNLDT

SEQ ID NO: 4188 - protein, 9 aa, Artificial Sequence
  Description of Artificial Sequence: Synthetic peptide
QQYDNFPLT

SEQ ID NO: 4189 - protein, 9 aa, Artificial Sequence
  Description of Artificial Sequence: Synthetic peptide
GFSLSTIGV

SEQ ID NO: 4190 - protein, 5 aa, Artificial Sequence
  Description of Artificial Sequence: Synthetic peptide
YWNDD

SEQ ID NO: 4191 - protein, 9 aa, Artificial Sequence
  Description of Artificial Sequence: Synthetic peptide
SHDWVHAFD

SEQ ID NO: 4192 - protein, 7 aa, Artificial Sequence
  Description of Artificial Sequence: Synthetic peptide
SQDISHY

SEQ ID NO: 4193 - protein, 3 aa, Artificial Sequence
  Description of Artificial Sequence: Synthetic peptide
DAS

SEQ ID NO: 4194 - protein, 6 aa, Artificial Sequence
  Description of Artificial Sequence: Synthetic peptide
YDNFPL

SEQ ID NO: 4195 - protein, 12 aa, Artificial Sequence
  Description of Artificial Sequence: Synthetic peptide
GFSLSTIGVGVG

SEQ ID NO: 4196 - protein, 9 aa, Artificial Sequence
  Description of Artificial Sequence: Synthetic peptide
LIYWNDDKR

SEQ ID NO: 4197 - protein, 10 aa, Artificial Sequence
  Description of Artificial Sequence: Synthetic peptide
SHDWVHAFDI

SEQ ID NO: 4198 - protein, 11 aa, Artificial Sequence
  Description of Artificial Sequence: Synthetic peptide
QASQDISHYLN

SEQ ID NO: 4199 - protein, 7 aa, Artificial Sequence
  Description of Artificial Sequence: Synthetic peptide
DASNLDT

SEQ ID NO: 4200 - protein, 9 aa, Artificial Sequence
  Description of Artificial Sequence: Synthetic peptide
QQYDNFPLT

SEQ ID NO: 4201 - protein, 8 aa, Artificial Sequence
  Description of Artificial Sequence: Synthetic peptide
STIGVGVG

SEQ ID NO: 4202 - protein, 12 aa, Artificial Sequence
  Description of Artificial Sequence: Synthetic peptide
WLSLIYWNDDKR

SEQ ID NO: 4203 - protein, 11 aa, Artificial Sequence
  Description of Artificial Sequence: Synthetic peptide
AHSHDWVHAFD

SEQ ID NO: 4204 - protein, 7 aa, Artificial Sequence
  Description of Artificial Sequence: Synthetic peptide
SHYLNWY

SEQ ID NO: 4205 - protein, 10 aa, Artificial Sequence
  Description of Artificial Sequence: Synthetic peptide
FLIYDASNLD

SEQ ID NO: 4206 - protein, 8 aa, Artificial Sequence
  Description of Artificial Sequence: Synthetic peptide
QQYDNFPL

SEQ ID NO: 4207 - protein, 10 aa, Artificial Sequence
  Description of Artificial Sequence: Synthetic peptide
GFSLSTIGVG

SEQ ID NO: 4208 - protein, 7 aa, Artificial Sequence
  Description of Artificial Sequence: Synthetic peptide
IYWNDDK

SEQ ID NO: 4209 - protein, 12 aa, Artificial Sequence
  Description of Artificial Sequence: Synthetic peptide
AHSHDWVHAFDI

SEQ ID NO: 4210 - protein, 6 aa, Artificial Sequence
  Description of Artificial Sequence: Synthetic peptide
QDISHY

SEQ ID NO: 4211 - protein, 3 aa, Artificial Sequence
  Description of Artificial Sequence: Synthetic peptide
DAS

SEQ ID NO: 4212 - protein, 9 aa, Artificial Sequence
  Description of Artificial Sequence: Synthetic peptide
QQYDNFPLT

SEQ ID NO: 4213 - protein, 120 aa, Artificial Sequence
  Description of Artificial Sequence: Synthetic polypeptide
EVQLLESGPTLVKPTQTLTLTCTFSGFSLSTIGVGVGWIRQPPGKALEWLSLIYWNDDKRYNPSLKSRLTITKDTSKNQVVLTMTNMDPVDTATYYCAHSHDWVHAFDIWGQGTMVTVSS

SEQ ID NO: 4214 - protein, 107 aa, Artificial Sequence
  Description of Artificial Sequence: Synthetic polypeptide
DIVMTQSPSSLSASVGDRVTITCQASQDISHYLNWYQQKPGKAPKFLIYDASNLDTGVPSRFSGSGSGTDFTFTISSLQPEDIATYYCQQYDNFPLTFGGGTKVEIK

SEQ ID NO: 4215 - protein, 450 aa, Artificial Sequence
  Description of Artificial Sequence: Synthetic polypeptide
EVQLLESGPTLVKPTQTLTLTCTFSGFSLSTIGVGVGWIRQPPGKALEWLSLIYWNDDKRYNPSLKSRLTITKDTSKNQVVLTMTNMDPVDTATYYCAHSHDWVHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4216 - protein, 214 aa, Artificial Sequence
  Description of Artificial Sequence: Synthetic polypeptide
DIVMTQSPSSLSASVGDRVTITCQASQDISHYLNWYQQKPGKAPKFLIYDASNLDTGVPSRFSGSGSGTDFTFTISSLQPEDIATYYCQQYDNFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4217 - protein, 5 aa, Artificial Sequence
  Description of Artificial Sequence: Synthetic peptide
GYYMH

SEQ ID NO: 4218 - protein, 17 aa, Artificial Sequence
  Description of Artificial Sequence: Synthetic peptide
WINPNSGATNKEQKFQG

SEQ ID NO: 4219 - protein, 7 aa, Artificial Sequence
  Description of Artificial Sequence: Synthetic peptide
EDDAFDV

SEQ ID NO: 4220 - protein, 11 aa, Artificial Sequence
  Description of Artificial Sequence: Synthetic peptide
QGDNLRNYYAT

SEQ ID NO: 4221 - protein, 7 aa, Artificial Sequence
  Description of Artificial Sequence: Synthetic peptide
GKNNRPS

SEQ ID NO: 4222 - protein, 11 aa, Artificial Sequence
  Description of Artificial Sequence: Synthetic peptide
NSRDSSGNHVV

SEQ ID NO: 4223 - protein, 7 aa, Artificial Sequence
  Description of Artificial Sequence: Synthetic peptide
GYTFTGY

SEQ ID NO: 4224 - protein, 6 aa, Artificial Sequence
  Description of Artificial Sequence: Synthetic peptide
NPNSGA

SEQ ID NO: 4225 - protein, 6 aa, Artificial Sequence
  Description of Artificial Sequence: Synthetic peptide
EDDAFD

SEQ ID NO: 4226 - protein, 7 aa, Artificial Sequence
  Description of Artificial Sequence: Synthetic peptide
DNLRNYY

SEQ ID NO: 4227 - protein, 3 aa, Artificial Sequence
  Description of Artificial Sequence: Synthetic peptide
GKN

SEQ ID NO: 4228 - protein, 8 aa, Artificial Sequence
  Description of Artificial Sequence: Synthetic peptide
RDSSGNHV

SEQ ID NO: 4229 - protein, 10 aa, Artificial Sequence
  Description of Artificial Sequence: Synthetic peptide
GYTFTGYYMH

SEQ ID NO: 4230 - protein, 10 aa, Artificial Sequence
  Description of Artificial Sequence: Synthetic peptide
WINPNSGATN

SEQ ID NO: 4231 - protein, 7 aa, Artificial Sequence
  Description of Artificial Sequence: Synthetic peptide
EDDAFDV

SEQ ID NO: 4232 - protein, 11 aa, Artificial Sequence
  Description of Artificial Sequence: Synthetic peptide
QGDNLRNYYAT

SEQ ID NO: 4233 - protein, 7 aa, Artificial Sequence
  Description of Artificial Sequence: Synthetic peptide
GKNNRPS

SEQ ID NO: 4234 - protein, 11 aa, Artificial Sequence
  Description of Artificial Sequence: Synthetic peptide
NSRDSSGNHVV

SEQ ID NO: 4235 - protein, 6 aa, Artificial Sequence
  Description of Artificial Sequence: Synthetic peptide
TGYYMH

SEQ ID NO: 4236 - protein, 13 aa, Artificial Sequence
  Description of Artificial Sequence: Synthetic peptide
WMGWINPNSGATN

SEQ ID NO: 4237 - protein, 8 aa, Artificial Sequence
  Description of Artificial Sequence: Synthetic peptide
AREDDAFD

SEQ ID NO: 4238 - protein, 7 aa, Artificial Sequence
  Description of Artificial Sequence: Synthetic peptide
NYYATWF

SEQ ID NO: 4239 - protein, 10 aa, Artificial Sequence
  Description of Artificial Sequence: Synthetic peptide
LVFFGKNNRP

SEQ ID NO: 4240 - protein, 10 aa, Artificial Sequence
  Description of Artificial Sequence: Synthetic peptide
NSRDSSGNHV

SEQ ID NO: 4241 - protein, 8 aa, Artificial Sequence
  Description of Artificial Sequence: Synthetic peptide
GYTFTGYY

SEQ ID NO: 4242 - protein, 8 aa, Artificial Sequence
  Description of Artificial Sequence: Synthetic peptide
INPNSGAT

SEQ ID NO: 4243 - protein, 9 aa, Artificial Sequence
  Description of Artificial Sequence: Synthetic peptide
AREDDAFDV

SEQ ID NO: 4244 - protein, 6 aa, Artificial Sequence
  Description of Artificial Sequence: Synthetic peptide
NLRNYY

SEQ ID NO: 4245 - protein, 3 aa, Artificial Sequence
  Description of Artificial Sequence: Synthetic peptide
GKN

SEQ ID NO: 4246 - protein, 11 aa, Artificial Sequence
  Description of Artificial Sequence: Synthetic peptide
NSRDSSGNHVV

SEQ ID NO: 4247 - protein, 116 aa, Artificial Sequence
  Description of Artificial Sequence: Synthetic polypeptide
QVQLVQSGAEVKKPGASVKVSCKASGYTFTGYYMHWMRQAPGQGLEWMGWINPNSGATNKEQKFQGRVTMTRDTSISTAYMELSRLRSDDTAVYYCAREDDAFDVWGQGTMVTVSS

SEQ ID NO: 4248 - protein, 108 aa, Artificial Sequence
  Description of Artificial Sequence: Synthetic polypeptide
SSELTQDPAVSVALGQTVRITCQGDNLRNYYATWFQQKPGQAPVLVFFGKNNRPSGIPDRFSGSSSGDTASLTITGAQAEDEADYYCNSRDSSGNHVVFGGGTKLTVL

SEQ ID NO: 4249 - protein, 446 aa, Artificial Sequence
  Description of Artificial Sequence: Synthetic polypeptide
QVQLVQSGAEVKKPGASVKVSCKASGYTFTGYYMHWMRQAPGQGLEWMGWINPNSGATNKEQKFQGRVTMTRDTSISTAYMELSRLRSDDTAVYYCAREDDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4250 - protein, 214 aa, Artificial Sequence
  Description of Artificial Sequence: Synthetic polypeptide
SSELTQDPAVSVALGQTVRITCQGDNLRNYYATWFQQKPGQAPVLVFFGKNNRPSGIPDRFSGSSSGDTASLTITGAQAEDEADYYCNSRDSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4251 - protein, 5 aa, Artificial Sequence
  Description of Artificial Sequence: Synthetic peptide
NYGMN

SEQ ID NO: 4252 - protein, 17 aa, Artificial Sequence
  Description of Artificial Sequence: Synthetic peptide
YISSGSSYKYYADSMKG

SEQ ID NO: 4253 - protein, 14 aa, Artificial Sequence
  Description of Artificial Sequence: Synthetic peptide
DPVVTEYYYYGMDV

SEQ ID NO: 4254 - protein, 11 aa, Artificial Sequence
  Description of Artificial Sequence: Synthetic peptide
RASQGINSWLA

SEQ ID NO: 4255 - protein, 7 aa, Artificial Sequence
  Description of Artificial Sequence: Synthetic peptide
AASSLQS

SEQ ID NO: 4256 - protein, 9 aa, Artificial Sequence
  Description of Artificial Sequence: Synthetic peptide
QQANSFPWT

SEQ ID NO: 4257 - protein, 7 aa, Artificial Sequence
  Description of Artificial Sequence: Synthetic peptide
GFTFSNY

SEQ ID NO: 4258 - protein, 6 aa, Artificial Sequence
  Description of Artificial Sequence: Synthetic peptide
SSGSSY

SEQ ID NO: 4259 - protein, 13 aa, Artificial Sequence
  Description of Artificial Sequence: Synthetic peptide
DPVVTEYYYYGMD

SEQ ID NO: 4260 - protein, 7 aa, Artificial Sequence
  Description of Artificial Sequence: Synthetic peptide
SQGINSW

SEQ ID NO: 4261 - protein, 3 aa, Artificial Sequence
  Description of Artificial Sequence: Synthetic peptide
AAS

SEQ ID NO: 4262 - protein, 6 aa, Artificial Sequence
  Description of Artificial Sequence: Synthetic peptide
ANSFPW

SEQ ID NO: 4263 - protein, 10 aa, Artificial Sequence
  Description of Artificial Sequence: Synthetic peptide
GFTFSNYGMN

SEQ ID NO: 4264 - protein, 10 aa, Artificial Sequence
  Description of Artificial Sequence: Synthetic peptide
YISSGSSYKY

SEQ ID NO: 4265 - protein, 14 aa, Artificial Sequence
  Description of Artificial Sequence: Synthetic peptide
DPVVTEYYYYGMDV

SEQ ID NO: 4266 - protein, 11 aa, Artificial Sequence
  Description of Artificial Sequence: Synthetic peptide
RASQGINSWLA

SEQ ID NO: 4267 - protein, 7 aa, Artificial Sequence
  Description of Artificial Sequence: Synthetic peptide
AASSLQS

SEQ ID NO: 4268 - protein, 9 aa, Artificial Sequence
  Description of Artificial Sequence: Synthetic peptide
QQANSFPWT

SEQ ID NO: 4269 - protein, 6 aa, Artificial Sequence
  Description of Artificial Sequence: Synthetic peptide
SNYGMN

SEQ ID NO: 4270 - protein, 13 aa, Artificial Sequence
  Description of Artificial Sequence: Synthetic peptide
WVSYISSGSSYKY

SEQ ID NO: 4271 - protein, 15 aa, Artificial Sequence
  Description of Artificial Sequence: Synthetic peptide
ARDPVVTEYYYYGMD

SEQ ID NO: 4272 - protein, 7 aa, Artificial Sequence
  Description of Artificial Sequence: Synthetic peptide
NSWLAWY

SEQ ID NO: 4273 - protein, 10 aa, Artificial Sequence
  Description of Artificial Sequence: Synthetic peptide
LLIYAASSLQ

SEQ ID NO: 4274 - protein, 8 aa, Artificial Sequence
  Description of Artificial Sequence: Synthetic peptide
QQANSFPW

SEQ ID NO: 4275 - protein, 8 aa, Artificial Sequence
  Description of Artificial Sequence: Synthetic peptide
GFTFSNYG

SEQ ID NO: 4276 - protein, 8 aa, Artificial Sequence
  Description of Artificial Sequence: Synthetic peptide
ISSGSSYK

SEQ ID NO: 4277 - protein, 16 aa, Artificial Sequence
  Description of Artificial Sequence: Synthetic peptide
ARDPVVTEYYYYGMDV

SEQ ID NO: 4278 - protein, 6 aa, Artificial Sequence
  Description of Artificial Sequence: Synthetic peptide
QGINSW

SEQ ID NO: 4279 - protein, 3 aa, Artificial Sequence
  Description of Artificial Sequence: Synthetic peptide
AAS

SEQ ID NO: 4280 - protein, 9 aa, Artificial Sequence
  Description of Artificial Sequence: Synthetic peptide
QQANSFPWT

SEQ ID NO: 4281 - protein, 123 aa, Artificial Sequence; identical to SEQ ID NO: 915
  Description of Artificial Sequence: Synthetic polypeptide

SEQ ID NO: 4282 - protein, 107 aa, Artificial Sequence
  Description of Artificial Sequence: Synthetic polypeptide
DIQMTQSPSSVSASVGDRVTITCRASQGINSWLAWYQQKPGNAPKLLIYAASSLQSGVPSRFSGIGSGTDFIFTISSLQPEDFASYYCQQANSFPWTFGQGTKVEIK

SEQ ID NO: 4283 - protein, 453 aa, Artificial Sequence; identical to SEQ ID NO: 917
  Description of Artificial Sequence: Synthetic polypeptide

SEQ ID NO: 4284 - protein, 214 aa, Artificial Sequence
  Description of Artificial Sequence: Synthetic polypeptide
DIQMTQSPSSVSASVGDRVTITCRASQGINSWLAWYQQKPGNAPKLLIYAASSLQSGVPSRFSGIGSGTDFIFTISSLQPEDFASYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4285 - protein, 5 aa, Artificial Sequence
  Description of Artificial Sequence: Synthetic peptide
SYSMI

SEQ ID NO: 4286 - protein, 17 aa, Artificial Sequence
  Description of Artificial Sequence: Synthetic peptide
SIGSSSTYIYYADSVRG

SEQ ID NO: 4287 - protein, 9 aa, Artificial Sequence
  Description of Artificial Sequence: Synthetic peptide
DGETGGFDY

SEQ ID NO: 4288 - protein, 12 aa, Artificial Sequence
  Description of Artificial Sequence: Synthetic peptide
RASQSISRSYLA

SEQ ID NO: 4289 - protein, 7 aa, Artificial Sequence
  Description of Artificial Sequence: Synthetic peptide
GPSNRAT

SEQ ID NO: 4290 - protein, 9 aa, Artificial Sequence
  Description of Artificial Sequence: Synthetic peptide
QQYGSLPLT

SEQ ID NO: 4291 - protein, 7 aa, Artificial Sequence
  Description of Artificial Sequence: Synthetic peptide
GFTFSSY

SEQ ID NO: 4292 - protein, 6 aa, Artificial Sequence
  Description of Artificial Sequence: Synthetic peptide
GSSSTY

SEQ ID NO: 4293 - protein, 8 aa, Artificial Sequence
  Description of Artificial Sequence: Synthetic peptide
DGETGGFD

SEQ ID NO: 4294 - protein, 8 aa, Artificial Sequence
  Description of Artificial Sequence: Synthetic peptide
SQSISRSY

SEQ ID NO: 4295 - protein, 3 aa, Artificial Sequence
  Description of Artificial Sequence: Synthetic peptide
GPS

SEQ ID NO: 4296 - protein, 6 aa, Artificial Sequence
  Description of Artificial Sequence: Synthetic peptide
YGSLPL

SEQ ID NO: 4297 - protein, 10 aa, Artificial Sequence
  Description of Artificial Sequence: Synthetic peptide
GFTFSSYSMI

SEQ ID NO: 4298 - protein, 10 aa, Artificial Sequence
  Description of Artificial Sequence: Synthetic peptide
SIGSSSTYIY

SEQ ID NO: 4299 - protein, 9 aa, Artificial Sequence
  Description of Artificial Sequence: Synthetic peptide
DGETGGFDY

SEQ ID NO: 4300 - protein, 12 aa, Artificial Sequence
  Description of Artificial Sequence: Synthetic peptide
RASQSISRSYLA

SEQ ID NO: 4301 - protein, 7 aa, Artificial Sequence
  Description of Artificial Sequence: Synthetic peptide
GPSNRAT

SEQ ID NO: 4302 - protein, 9 aa, Artificial Sequence
  Description of Artificial Sequence: Synthetic peptide
QQYGSLPLT

SEQ ID NO: 4303 - protein, 6 aa, Artificial Sequence
  Description of Artificial Sequence: Synthetic peptide
SSYSMI

SEQ ID NO: 4304 - protein, 13 aa, Artificial Sequence
  Description of Artificial Sequence: Synthetic peptide
WVSSIGSSSTYIY

SEQ ID NO: 4305 - protein, 10 aa, Artificial Sequence
  Description of Artificial Sequence: Synthetic peptide
ARDGETGGFD

SEQ ID NO: 4306 - protein, 8 aa, Artificial Sequence
  Description of Artificial Sequence: Synthetic peptide
SRSYLAWY

SEQ ID NO: 4307 - protein, 10 aa, Artificial Sequence
  Description of Artificial Sequence: Synthetic peptide
LLIYGPSNRA

SEQ ID NO: 4308 - protein, 8 aa, Artificial Sequence
  Description of Artificial Sequence: Synthetic peptide
QQYGSLPL

SEQ ID NO: 4309 - protein, 8 aa, Artificial Sequence
  Description of Artificial Sequence: Synthetic peptide
GFTFSSYS

SEQ ID NO: 4310 - protein, 8 aa, Artificial Sequence
  Description of Artificial Sequence: Synthetic peptide
IGSSSTYI

SEQ ID NO: 4311 - protein, 11 aa, Artificial Sequence
  Description of Artificial Sequence: Synthetic peptide
ARDGETGGFDY

SEQ ID NO: 4312 - protein, 7 aa, Artificial Sequence
  Description of Artificial Sequence: Synthetic peptide
QSISRSY

SEQ ID NO: 4313 - protein, 3 aa, Artificial Sequence
  Description of Artificial Sequence: Synthetic peptide
GPS

SEQ ID NO: 4314 - protein, 9 aa, Artificial Sequence
  Description of Artificial Sequence: Synthetic peptide
QQYGSLPLT

SEQ ID NO: 4315 - protein, 118 aa, Artificial Sequence
  Description of Artificial Sequence: Synthetic polypeptide
EVQLVESGGGLVKPGGSLRLSCAASGFTFSSYSMIWVRQAPGKGLEWVSSIGSSSTYIYYADSVRGRFTISRDNAKTSLYLQMNSLRAEDTAMYFCARDGETGGFDYWGQGILVTVSS

SEQ ID NO: 4316 - protein, 108 aa, Artificial Sequence
  Description of Artificial Sequence: Synthetic polypeptide
EIVMTQSPGTLSLSPGERATLSCRASQSISRSYLAWYQQKPGQPPRLLIYGPSNRATGIPDRFSASGSGTDFTLTNSRLEPEDFAVYYCQQYGSLPLTFGGGTKVEIK

SEQ ID NO: 4317 - protein, 448 aa, Artificial Sequence
  Description of Artificial Sequence: Synthetic polypeptide
EVQLVESGGGLVKPGGSLRLSCAASGFTFSSYSMIWVRQAPGKGLEWVSSIGSSSTYIYYADSVRGRFTISRDNAKTSLYLQMNSLRAEDTAMYFCARDGETGGFDYWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4318 - protein, 215 aa, Artificial Sequence
  Description of Artificial Sequence: Synthetic polypeptide
EIVMTQSPGTLSLSPGERATLSCRASQSISRSYLAWYQQKPGQPPRLLIYGPSNRATGIPDRFSASGSGTDFTLTNSRLEPEDFAVYYCQQYGSLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4319 - protein, 5 aa, Artificial Sequence
  Description of Artificial Sequence: Synthetic peptide
SYDMN

SEQ ID NO: 4320 - protein, 17 aa, Artificial Sequence
  Description of Artificial Sequence: Synthetic peptide
YISSSSTAKYYADSVKG

SEQ ID NO: 4321 - protein, 12 aa, Artificial Sequence
  Description of Artificial Sequence: Synthetic peptide
EDIVVVTPILQH

SEQ ID NO: 4322 - protein, 11 aa, Artificial Sequence
  Description of Artificial Sequence: Synthetic peptide
RASQSVSKDLA

SEQ ID NO: 4323 - protein, 7 aa, Artificial Sequence
  Description of Artificial Sequence: Synthetic peptide
DASNRAT

SEQ ID NO: 4324 - protein, 10 aa, Artificial Sequence
  Description of Artificial Sequence: Synthetic peptide
QQRINWPLFT

SEQ ID NO: 4325 - protein, 7 aa, Artificial Sequence
  Description of Artificial Sequence: Synthetic peptide
GFTFSSY

SEQ ID NO: 4326 - protein, 6 aa, Artificial Sequence
  Description of Artificial Sequence: Synthetic peptide
SSSSTA

SEQ ID NO: 4327 - protein, 11 aa, Artificial Sequence
  Description of Artificial Sequence: Synthetic peptide
EDIVVVTPILQ

SEQ ID NO: 4328 - protein, 7 aa, Artificial Sequence
  Description of Artificial Sequence: Synthetic peptide
SQSVSKD

SEQ ID NO: 4329 - protein, 3 aa, Artificial Sequence
  Description of Artificial Sequence: Synthetic peptide
DAS

SEQ ID NO: 4330 - protein, 7 aa, Artificial Sequence
  Description of Artificial Sequence: Synthetic peptide
RINWPLF

SEQ ID NO: 4331 - protein, 10 aa, Artificial Sequence
  Description of Artificial Sequence: Synthetic peptide
GFTFSSYDMN

SEQ ID NO: 4332 - protein, 10 aa, Artificial Sequence
  Description of Artificial Sequence: Synthetic peptide
YISSSSTAKY

SEQ ID NO: 4333 - protein, 12 aa, Artificial Sequence
  Description of Artificial Sequence: Synthetic peptide
EDIVVVTPILQH

SEQ ID NO: 4334 - protein, 11 aa, Artificial Sequence
  Description of Artificial Sequence: Synthetic peptide
RASQSVSKDLA

SEQ ID NO: 4335 - protein, 7 aa, Artificial Sequence
  Description of Artificial Sequence: Synthetic peptide
DASNRAT

SEQ ID NO: 4336 - protein, 10 aa, Artificial Sequence
  Description of Artificial Sequence: Synthetic peptide
QQRINWPLFT

SEQ ID NO: 4337 - protein, 6 aa, Artificial Sequence
  Description of Artificial Sequence: Synthetic peptide
SSYDMN

SEQ ID NO: 4338 - protein, 13 aa, Artificial Sequence
  Description of Artificial Sequence: Synthetic peptide
WVSYISSSSTAKY

SEQ ID NO: 4339 - protein, 13 aa, Artificial Sequence
  Description of Artificial Sequence: Synthetic peptide
AREDIVVVTPILQ

SEQ ID NO: 4340 - protein, 7 aa, Artificial Sequence
  Description of Artificial Sequence: Synthetic peptide
SKDLAWY

SEQ ID NO: 4341 - protein, 10 aa, Artificial Sequence
  Description of Artificial Sequence: Synthetic peptide
LLIYDASNRA

SEQ ID NO: 4342 - protein, 9 aa, Artificial Sequence
  Description of Artificial Sequence: Synthetic peptide
QQRINWPLF

SEQ ID NO: 4343 - protein, 8 aa, Artificial Sequence
  Description of Artificial Sequence: Synthetic peptide
GFTFSSYD

SEQ ID NO: 4344 - protein, 8 aa, Artificial Sequence
  Description of Artificial Sequence: Synthetic peptide
ISSSSTAK

SEQ ID NO: 4345 - protein, 14 aa, Artificial Sequence
  Description of Artificial Sequence: Synthetic peptide
AREDIVVVTPILQH

SEQ ID NO: 4346 - protein, 6 aa, Artificial Sequence
  Description of Artificial Sequence: Synthetic peptide
QSVSKD

SEQ ID NO: 4347 - protein, 3 aa, Artificial Sequence
  Description of Artificial Sequence: Synthetic peptide
DAS

SEQ ID NO: 4348 - protein, 10 aa, Artificial Sequence
  Description of Artificial Sequence: Synthetic peptide
QQRINWPLFT

SEQ ID NO: 4349 - protein, 121 aa, Artificial Sequence
  Description of Artificial Sequence: Synthetic polypeptide
EVQLVESGGTLVQPGGSLRLSCAVSGFTFSSYDMNWVRQAPGKGLEWVSYISSSSTAKYYADSVKGRFTISRDNAKNSLYLQMNSLWDEDTAVYYCAREDIVVVTPILQHWGQGTTVTVSS

SEQ ID NO: 4350 - protein, 108 aa, Artificial Sequence
  Description of Artificial Sequence: Synthetic polypeptide
EIVMTQSPATLSLSPGERAILSCRASQSVSKDLAWYQQKPGQAPRLLIYDASNRATGIPARISGSGSGTDFTLTISSLEPEDFAVYYCQQRINWPLFTFGPGTKVEIK

SEQ ID NO: 4351 - protein, 451 aa, Artificial Sequence
  Description of Artificial Sequence: Synthetic polypeptide
EVQLVESGGTLVQPGGSLRLSCAVSGFTFSSYDMNWVRQAPGKGLEWVSYISSSSTAKYYADSVKGRFTISRDNAKNSLYLQMNSLWDEDTAVYYCAREDIVVVTPILQHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4352 - protein, 215 aa, Artificial Sequence
  Description of Artificial Sequence: Synthetic polypeptide
EIVMTQSPATLSLSPGERAILSCRASQSVSKDLAWYQQKPGQAPRLLIYDASNRATGIPARISGSGSGTDFTLTISSLEPEDFAVYYCQQRINWPLFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4353 - protein, 7 aa, Artificial Sequence
  Description of Artificial Sequence: Synthetic peptide
SNSAAWN

SEQ ID NO: 4354 - protein, 18 aa, Artificial Sequence
  Description of Artificial Sequence: Synthetic peptide
GTYYRSKWFNNYAVSVKS

SEQ ID NO: 4355 - protein, 11 aa, Artificial Sequence
  Description of Artificial Sequence: Synthetic peptide
GEWGLRDAFDI

SEQ ID NO: 4356 - protein, 11 aa, Artificial Sequence
  Description of Artificial Sequence: Synthetic peptide
RASQGIHSYLA

SEQ ID NO: 4357 - protein, 7 aa, Artificial Sequence
  Description of Artificial Sequence: Synthetic peptide
VASTLQS

SEQ ID NO: 4358 - protein, 9 aa, Artificial Sequence
  Description of Artificial Sequence: Synthetic peptide
QQLNSYPWT

SEQ ID NO: 4359 - protein, 9 aa, Artificial Sequence
  Description of Artificial Sequence: Synthetic peptide
GDSVSSNSA

SEQ ID NO: 4360 - protein, 7 aa, Artificial Sequence
  Description of Artificial Sequence: Synthetic peptide
YYRSKWF

SEQ ID NO: 4361 - protein, 10 aa, Artificial Sequence
  Description of Artificial Sequence: Synthetic peptide
GEWGLRDAFD

SEQ ID NO: 4362 - protein, 7 aa, Artificial Sequence
  Description of Artificial Sequence: Synthetic peptide
SQGIHSY

SEQ ID NO: 4363 - protein, 3 aa, Artificial Sequence
  Description of Artificial Sequence: Synthetic peptide
VAS

SEQ ID NO: 4364 - protein, 6 aa, Artificial Sequence
  Description of Artificial Sequence: Synthetic peptide
LNSYPW

SEQ ID NO: 4365 - protein, 12 aa, Artificial Sequence
  Description of Artificial Sequence: Synthetic peptide
GDSVSSNSAAWN

SEQ ID NO: 4366 - protein, 11 aa, Artificial Sequence
  Description of Artificial Sequence: Synthetic peptide
GTYYRSKWFNN

SEQ ID NO: 4367 - protein, 11 aa, Artificial Sequence
  Description of Artificial Sequence: Synthetic peptide
GEWGLRDAFDI

SEQ ID NO: 4368 - protein, 11 aa, Artificial Sequence
  Description of Artificial Sequence: Synthetic peptide
RASQGIHSYLA

SEQ ID NO: 4369 - protein, 7 aa, Artificial Sequence
  Description of Artificial Sequence: Synthetic peptide
VASTLQS

SEQ ID NO: 4370 - protein, 9 aa, Artificial Sequence
  Description of Artificial Sequence: Synthetic peptide
QQLNSYPWT

SEQ ID NO: 4371 - protein, 8 aa, Artificial Sequence
  Description of Artificial Sequence: Synthetic peptide
SSNSAAWN

SEQ ID NO: 4372 - protein, 14 aa, Artificial Sequence
  Description of Artificial Sequence: Synthetic peptide
WLGGTYYRSKWFNN

SEQ ID NO: 4373 - protein, 12 aa, Artificial Sequence
  Description of Artificial Sequence: Synthetic peptide
ARGEWGLRDAFD

SEQ ID NO: 4374 - protein, 7 aa, Artificial Sequence
  Description of Artificial Sequence: Synthetic peptide
HSYLAWY

SEQ ID NO: 4375 - protein, 10 aa, Artificial Sequence
  Description of Artificial Sequence: Synthetic peptide
LLIYVASTLQ

SEQ ID NO: 4376 - protein, 8 aa, Artificial Sequence
  Description of Artificial Sequence: Synthetic peptide
QQLNSYPW

SEQ ID NO: 4377 - protein, 10 aa, Artificial Sequence
  Description of Artificial Sequence: Synthetic peptide
GDSVSSNSAA

SEQ ID NO: 4378 - protein, 9 aa, Artificial Sequence
  Description of Artificial Sequence: Synthetic peptide
TYYRSKWFN

SEQ ID NO: 4379 - protein, 13 aa, Artificial Sequence
  Description of Artificial Sequence: Synthetic peptide
ARGEWGLRDAFDI

SEQ ID NO: 4380 - protein, 6 aa, Artificial Sequence
  Description of Artificial Sequence: Synthetic peptide
QGIHSY

SEQ ID NO: 4381 - protein, 3 aa, Artificial Sequence
  Description of Artificial Sequence: Synthetic peptide
VAS

SEQ ID NO: 4382 - protein, 9 aa, Artificial Sequence
  Description of Artificial Sequence: Synthetic peptide
QQLNSYPWT

SEQ ID NO: 4383 - protein, 123 aa, Artificial Sequence
  Description of Artificial Sequence: Synthetic polypeptide
QVQLQQSGPGLVKPSQTLSLTCAISGDSVSSNSAAWNWIRQSPSRGLEWLGGTYYRSKWFNNYAVSVKSRITINPDTSTNQFSLQLNSVTPADTAVYYCARGEWGLRDAFDIWGQGTMVTVSS

SEQ ID NO: 4384 - protein, 107 aa, Artificial Sequence
  Description of Artificial Sequence: Synthetic polypeptide
DIQMTQSPSFLSASVGDRVIITCRASQGIHSYLAWYQQKPGKVPKLLIYVASTLQSGVPSRFSGSGSGTEFTLTISSLQPEDFATYYCQQLNSYPWTFGQGTKLEIK

SEQ ID NO: 4385 - protein, 453 aa, Artificial Sequence
  Description of Artificial Sequence: Synthetic polypeptide
QVQLQQSGPGLVKPSQTLSLTCAISGDSVSSNSAAWNWIRQSPSRGLEWLGGTYYRSKWFNNYAVSVKSRITINPDTSTNQFSLQLNSVTPADTAVYYCARGEWGLRDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4386 - protein, 214 aa, Artificial Sequence
  Description of Artificial Sequence: Synthetic polypeptide
DIQMTQSPSFLSASVGDRVIITCRASQGIHSYLAWYQQKPGKVPKLLIYVASTLQSGVPSRFSGSGSGTEFTLTISSLQPEDFATYYCQQLNSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4387 - protein, 5 aa, Artificial Sequence
  Description of Artificial Sequence: Synthetic peptide
SYDMN

SEQ ID NO: 4388 - protein, 17 aa, Artificial Sequence
  Description of Artificial Sequence: Synthetic peptide
SISSSSSYIYYADSVKG

SEQ ID NO: 4389 - protein, 16 aa, Artificial Sequence
  Description of Artificial Sequence: Synthetic peptide
DRGVGGTDYYYYGLDV

SEQ ID NO: 4390 - protein, 12 aa, Artificial Sequence
  Description of Artificial Sequence: Synthetic peptide
RASQSVSSSYLA

SEQ ID NO: 4391 - protein, 7 aa, Artificial Sequence
  Description of Artificial Sequence: Synthetic peptide
GASSRAT

SEQ ID NO: 4392 - protein, 10 aa, Artificial Sequence
  Description of Artificial Sequence: Synthetic peptide
QQYGSSPPYT

SEQ ID NO: 4393 - protein, 7 aa, Artificial Sequence
  Description of Artificial Sequence: Synthetic peptide
RFTLSSY

SEQ ID NO: 4394 - protein, 6 aa, Artificial Sequence
  Description of Artificial Sequence: Synthetic peptide
SSSSSY

SEQ ID NO: 4395 - protein, 15 aa, Artificial Sequence
  Description of Artificial Sequence: Synthetic peptide
DRGVGGTDYYYYGLD

SEQ ID NO: 4396 - protein, 8 aa, Artificial Sequence
  Description of Artificial Sequence: Synthetic peptide
SQSVSSSY

SEQ ID NO: 4397 - protein, 3 aa, Artificial Sequence
  Description of Artificial Sequence: Synthetic peptide
GAS

SEQ ID NO: 4398 - protein, 7 aa, Artificial Sequence
  Description of Artificial Sequence: Synthetic peptide
YGSSPPY

SEQ ID NO: 4399 - protein, 10 aa, Artificial Sequence
  Description of Artificial Sequence: Synthetic peptide
RFTLSSYDMN

SEQ ID NO: 4400 - protein, 10 aa, Artificial Sequence
  Description of Artificial Sequence: Synthetic peptide
SISSSSSYIY

SEQ ID NO: 4401 - protein, 16 aa, Artificial Sequence
  Description of Artificial Sequence: Synthetic peptide
DRGVGGTDYYYYGLDV

SEQ ID NO: 4402 - protein, 12 aa, Artificial Sequence
  Description of Artificial Sequence: Synthetic peptide
RASQSVSSSYLA

SEQ ID NO: 4403 - protein, 7 aa, Artificial Sequence
  Description of Artificial Sequence: Synthetic peptide
GASSRAT

SEQ ID NO: 4404 - protein, 10 aa, Artificial Sequence
  Description of Artificial Sequence: Synthetic peptide
QQYGSSPPYT

SEQ ID NO: 4405 - protein, 6 aa, Artificial Sequence
  Description of Artificial Sequence: Synthetic peptide
SSYDMN

SEQ ID NO: 4406 - protein, 13 aa, Artificial Sequence
  Description of Artificial Sequence: Synthetic peptide
WVSSISSSSSYIY

SEQ ID NO: 4407 - protein, 17 aa, Artificial Sequence
  Description of Artificial Sequence: Synthetic peptide
ARDRGVGGTDYYYYGLD

SEQ ID NO: 4408 - protein, 8 aa, Artificial Sequence
  Description of Artificial Sequence: Synthetic peptide
SSSYLAWY

SEQ ID NO: 4409 - protein, 10 aa, Artificial Sequence
  Description of Artificial Sequence: Synthetic peptide
LLIYGASSRA

SEQ ID NO: 4410 - protein, 9 aa, Artificial Sequence
  Description of Artificial Sequence: Synthetic peptide
QQYGSSPPY

SEQ ID NO: 4411 - protein, 8 aa, Artificial Sequence
  Description of Artificial Sequence: Synthetic peptide
RFTLSSYD

SEQ ID NO: 4412 - protein, 8 aa, Artificial Sequence
  Description of Artificial Sequence: Synthetic peptide
ISSSSSYI

SEQ ID NO: 4413 - protein, 18 aa, Artificial Sequence
  Description of Artificial Sequence: Synthetic peptide
ARDRGVGGTDYYYYGLDV

SEQ ID NO: 4414 - protein, 7 aa, Artificial Sequence
  Description of Artificial Sequence: Synthetic peptide
QSVSSSY

SEQ ID NO: 4415 - protein, 3 aa, Artificial Sequence
  Description of Artificial Sequence: Synthetic peptide
GAS

SEQ ID NO: 4416 - protein, 10 aa, Artificial Sequence
  Description of Artificial Sequence: Synthetic peptide
QQYGSSPPYT

SEQ ID NO: 4417 - protein, 125 aa, Artificial Sequence
  Description of Artificial Sequence: Synthetic polypeptide
EVQLLESGGGLVKPGGSLRLSCAASRFTLSSYDMNWVRQAPGKGLEWVSSISSSSSYIYYADSVKGRFTISRDNAKNSLYLQMNSLRAEDTAVYYCARDRGVGGTDYYYYGLDVWGQGTTVTVSS

SEQ ID NO: 4418 - protein, 109 aa, Artificial Sequence; identical to SEQ ID NO: 406
  Description of Artificial Sequence: Synthetic polypeptide

SEQ ID NO: 4419 - protein, 455 aa, Artificial Sequence
  Description of Artificial Sequence: Synthetic polypeptide
EVQLLESGGGLVKPGGSLRLSCAASRFTLSSYDMNWVRQAPGKGLEWVSSISSSSSYIYYADSVKGRFTISRDNAKNSLYLQMNSLRAEDTAVYYCARDRGVGGTDYYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4420 - protein, 216 aa, Artificial Sequence; identical to SEQ ID NO: 408
  Description of Artificial Sequence: Synthetic polypeptide

SEQ ID NO: 4421 - protein, 5 aa, Artificial Sequence
  Description of Artificial Sequence: Synthetic peptide
GYYLQ

SEQ ID NO: 4422 - protein, 17 aa, Artificial Sequence
  Description of Artificial Sequence: Synthetic peptide
WINPNSGYTDYAQRFQD

SEQ ID NO: 4423 - protein, 7 aa, Artificial Sequence
  Description of Artificial Sequence: Synthetic peptide
LDDAFDV

SEQ ID NO: 4424 - protein, 11 aa, Artificial Sequence
  Description of Artificial Sequence: Synthetic peptide
QGDSLRNYYAI

SEQ ID NO: 4425 - protein, 7 aa, Artificial Sequence
  Description of Artificial Sequence: Synthetic peptide
GKNNRPS

SEQ ID NO: 4426 - protein, 11 aa, Artificial Sequence
  Description of Artificial Sequence: Synthetic peptide
NSRDSSGNHWV

SEQ ID NO: 4427 - protein, 7 aa, Artificial Sequence
  Description of Artificial Sequence: Synthetic peptide
GFTFTGY

SEQ ID NO: 4428 - protein, 6 aa, Artificial Sequence
  Description of Artificial Sequence: Synthetic peptide
NPNSGY

SEQ ID NO: 4429 - protein, 6 aa, Artificial Sequence
  Description of Artificial Sequence: Synthetic peptide
LDDAFD

SEQ ID NO: 4430 - protein, 7 aa, Artificial Sequence
  Description of Artificial Sequence: Synthetic peptide
DSLRNYY

SEQ ID NO: 4431 - protein, 3 aa, Artificial Sequence
  Description of Artificial Sequence: Synthetic peptide
GKN

SEQ ID NO: 4432 - protein, 8 aa, Artificial Sequence
  Description of Artificial Sequence: Synthetic peptide
RDSSGNHW

SEQ ID NO: 4433 - protein, 10 aa, Artificial Sequence
  Description of Artificial Sequence: Synthetic peptide
GFTFTGYYLQ

SEQ ID NO: 4434 - protein, 10 aa, Artificial Sequence
  Description of Artificial Sequence: Synthetic peptide
WINPNSGYTD

SEQ ID NO: 4435 - protein, 7 aa, Artificial Sequence
  Description of Artificial Sequence: Synthetic peptide
LDDAFDV

SEQ ID NO: 4436 - protein, 11 aa, Artificial Sequence
  Description of Artificial Sequence: Synthetic peptide
QGDSLRNYYAI

SEQ ID NO: 4437 - protein, 7 aa, Artificial Sequence
  Description of Artificial Sequence: Synthetic peptide
GKNNRPS

SEQ ID NO: 4438 - protein, 11 aa, Artificial Sequence
  Description of Artificial Sequence: Synthetic peptide
NSRDSSGNHWV

SEQ ID NO: 4439 - protein, 6 aa, Artificial Sequence
  Description of Artificial Sequence: Synthetic peptide
TGYYLQ

SEQ ID NO: 4440 - protein, 13 aa, Artificial Sequence
  Description of Artificial Sequence: Synthetic peptide
WMGWINPNSGYTD

SEQ ID NO: 4441 - protein, 8 aa, Artificial Sequence
  Description of Artificial Sequence: Synthetic peptide
ARLDDAFD

SEQ ID NO: 4442 - protein, 7 aa, Artificial Sequence
  Description of Artificial Sequence: Synthetic peptide
NYYAIWY

SEQ ID NO: 4443 - protein, 10 aa, Artificial Sequence
  Description of Artificial Sequence: Synthetic peptide
LVIFGKNNRP

SEQ ID NO: 4444 - protein, 10 aa, Artificial Sequence
  Description of Artificial Sequence: Synthetic peptide
NSRDSSGNHW

SEQ ID NO: 4445 - protein, 8 aa, Artificial Sequence
  Description of Artificial Sequence: Synthetic peptide
GFTFTGYY

SEQ ID NO: 4446 - protein, 8 aa, Artificial Sequence
  Description of Artificial Sequence: Synthetic peptide
INPNSGYT

SEQ ID NO: 4447 - protein, 9 aa, Artificial Sequence
  Description of Artificial Sequence: Synthetic peptide
ARLDDAFDV

SEQ ID NO: 4448 - protein, 6 aa, Artificial Sequence
  Description of Artificial Sequence: Synthetic peptide
SLRNYY

SEQ ID NO: 4449 - protein, 3 aa, Artificial Sequence
  Description of Artificial Sequence: Synthetic peptide
GKN

SEQ ID NO: 4450 - protein, 11 aa, Artificial Sequence
  Description of Artificial Sequence: Synthetic peptide
NSRDSSGNHWV

SEQ ID NO: 4451 - protein, 116 aa, Artificial Sequence
  Description of Artificial Sequence: Synthetic polypeptide
EVQLVESGAEVKKPGASVKVSCKASGFTFTGYYLQWVRQAPGQGLEWMGWINPNSGYTDYAQRFQDRVTMTRDTSINTAYMELSRLRSDDTAVYYCARLDDAFDVWGQGTMVTVSS

SEQ ID NO: 4452 - protein, 108 aa, Artificial Sequence
  Description of Artificial Sequence: Synthetic polypeptide
SYELTQDPAVSVALGQTVRITCQGDSLRNYYAIWYQQKPGQAPVLVIFGKNNRPSGIPDRFSGSSSGTTASLTITGTQAEDEADYYCNSRDSSGNHWVFGGGTKLTVL

SEQ ID NO: 4453 - protein, 446 aa, Artificial Sequence
  Description of Artificial Sequence: Synthetic polypeptide
EVQLVESGAEVKKPGASVKVSCKASGFTFTGYYLQWVRQAPGQGLEWMGWINPNSGYTDYAQRFQDRVTMTRDTSINTAYMELSRLRSDDTAVYYCARLDDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4454 - protein, 214 aa, Artificial Sequence
  Description of Artificial Sequence: Synthetic polypeptide
SYELTQDPAVSVALGQTVRITCQGDSLRNYYAIWYQQKPGQAPVLVIFGKNNRPSGIPDRFSGSSSGTTASLTITGTQAEDEADYYCNSRDSSGNHWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4455 - protein, 5 aa, Artificial Sequence
  Description of Artificial Sequence: Synthetic peptide
NYAIS

SEQ ID NO: 4456 - protein, 17 aa, Artificial Sequence
  Description of Artificial Sequence: Synthetic peptide
GIIPFFGTPDYAQKFQG

SEQ ID NO: 4457 - protein, 15 aa, Artificial Sequence
  Description of Artificial Sequence: Synthetic peptide
GGGYGDYDYYYGINV

SEQ ID NO: 4458 - protein, 16 aa, Artificial Sequence
  Description of Artificial Sequence: Synthetic peptide
RSSQSLVHSDGNTYLS

SEQ ID NO: 4459 - protein, 7 aa, Artificial Sequence
  Description of Artificial Sequence: Synthetic peptide
KISNRFS

SEQ ID NO: 4460 - protein, 9 aa, Artificial Sequence
  Description of Artificial Sequence: Synthetic peptide
MQAKEFPLT

SEQ ID NO: 4461 - protein, 7 aa, Artificial Sequence
  Description of Artificial Sequence: Synthetic peptide
GGSFSNY

SEQ ID NO: 4462 - protein, 6 aa, Artificial Sequence
  Description of Artificial Sequence: Synthetic peptide
IPFFGT

SEQ ID NO: 4463 - protein, 14 aa, Artificial Sequence
  Description of Artificial Sequence: Synthetic peptide
GGGYGDYDYYYGIN

SEQ ID NO: 4464 - protein, 12 aa, Artificial Sequence
  Description of Artificial Sequence: Synthetic peptide
SQSLVHSDGNTY

SEQ ID NO: 4465 - protein, 3 aa, Artificial Sequence
  Description of Artificial Sequence: Synthetic peptide
KIS

SEQ ID NO: 4466 - protein, 6 aa, Artificial Sequence
  Description of Artificial Sequence: Synthetic peptide
AKEFPL

SEQ ID NO: 4467 - protein, 10 aa, Artificial Sequence
  Description of Artificial Sequence: Synthetic peptide
GGSFSNYAIS

SEQ ID NO: 4468 - protein, 10 aa, Artificial Sequence
  Description of Artificial Sequence: Synthetic peptide
GIIPFFGTPD

SEQ ID NO: 4469 - protein, 15 aa, Artificial Sequence
  Description of Artificial Sequence: Synthetic peptide
GGGYGDYDYYYGINV

SEQ ID NO: 4470 - protein, 16 aa, Artificial Sequence
  Description of Artificial Sequence: Synthetic peptide
RSSQSLVHSDGNTYLS

SEQ ID NO: 4471 - protein, 7 aa, Artificial Sequence
  Description of Artificial Sequence: Synthetic peptide
KISNRFS

SEQ ID NO: 4472 - protein, 9 aa, Artificial Sequence
  Description of Artificial Sequence: Synthetic peptide
MQAKEFPLT

SEQ ID NO: 4473 - protein, 6 aa, Artificial Sequence
  Description of Artificial Sequence: Synthetic peptide
SNYAIS

SEQ ID NO: 4474 - protein, 13 aa, Artificial Sequence
  Description of Artificial Sequence: Synthetic peptide
WMGGIIPFFGTPD

SEQ ID NO: 4475 - protein, 16 aa, Artificial Sequence
  Description of Artificial Sequence: Synthetic peptide
STGGGYGDYDYYYGIN

SEQ ID NO: 4476 - protein, 12 aa, Artificial Sequence
  Description of Artificial Sequence: Synthetic peptide
VHSDGNTYLSWL

SEQ ID NO: 4477 - protein, 10 aa, Artificial Sequence
  Description of Artificial Sequence: Synthetic peptide
LLIYKISNRF

SEQ ID NO: 4478 - protein, 8 aa, Artificial Sequence
  Description of Artificial Sequence: Synthetic peptide
MQAKEFPL

SEQ ID NO: 4479 - protein, 8 aa, Artificial Sequence
  Description of Artificial Sequence: Synthetic peptide
GGSFSNYA

SEQ ID NO: 4480 - protein, 8 aa, Artificial Sequence
  Description of Artificial Sequence: Synthetic peptide
IIPFFGTP

SEQ ID NO: 4481 - protein, 17 aa, Artificial Sequence
  Description of Artificial Sequence: Synthetic peptide
STGGGYGDYDYYYGINV

SEQ ID NO: 4482 - protein, 11 aa, Artificial Sequence
  Description of Artificial Sequence: Synthetic peptide
QSLVHSDGNTY

SEQ ID NO: 4483 - protein, 3 aa, Artificial Sequence
  Description of Artificial Sequence: Synthetic peptide
KIS

SEQ ID NO: 4484 - protein, 9 aa, Artificial Sequence
  Description of Artificial Sequence: Synthetic peptide
MQAKEFPLT

SEQ ID NO: 4485 - protein, 124 aa, Artificial Sequence
  Description of Artificial Sequence: Synthetic polypeptide
QVQLVQSGAEVKKPGSSVKVSCKASGGSFSNYAISWMRQAPGQGLEWMGGIIPFFGTPDYAQKFQGRVTITADKSTSTAYMELSSLRSEDTAVYYCSTGGGYGDYDYYYGINVWGQGTMVTVSS

SEQ ID NO: 4486 - protein, 112 aa, Artificial Sequence
  Description of Artificial Sequence: Synthetic polypeptide
DIVMTQSPLSSPVDLGQPASISCRSSQSLVHSDGNTYLSWLQQRPGQPPRLLIYKISNRFSGVPDRFSGSGAGTDFTLKISRVEAEDVGVYYCMQAKEFPLTLGGGTKVDIK

SEQ ID NO: 4487 - protein, 454 aa, Artificial Sequence
  Description of Artificial Sequence: Synthetic polypeptide
QVQLVQSGAEVKKPGSSVKVSCKASGGSFSNYAISWMRQAPGQGLEWMGGIIPFFGTPDYAQKFQGRVTITADKSTSTAYMELSSLRSEDTAVYYCSTGGGYGDYDYYYGINVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4488 - protein, 219 aa, Artificial Sequence
  Description of Artificial Sequence: Synthetic polypeptide
DIVMTQSPLSSPVDLGQPASISCRSSQSLVHSDGNTYLSWLQQRPGQPPRLLIYKISNRFSGVPDRFSGSGAGTDFTLKISRVEAEDVGVYYCMQAKEFPLTLGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4489 - protein, 5 aa, Artificial Sequence
  Description of Artificial Sequence: Synthetic peptide
GDYIH

SEQ ID NO: 4490 - protein, 17 aa, Artificial Sequence
  Description of Artificial Sequence: Synthetic peptide
WINPNSGGTNYAQKFQG

SEQ ID NO: 4491 - protein, 14 aa, Artificial Sequence
  Description of Artificial Sequence: Synthetic peptide
EGGVAPAAPDAFDI

SEQ ID NO: 4492 - protein, 11 aa, Artificial Sequence
  Description of Artificial Sequence: Synthetic peptide
QGDSLRSYYAR

SEQ ID NO: 4493 - protein, 7 aa, Artificial Sequence
  Description of Artificial Sequence: Synthetic peptide
GKNNRPS

SEQ ID NO: 4494 - protein, 11 aa, Artificial Sequence
  Description of Artificial Sequence: Synthetic peptide
NSRDSSGNHRV

SEQ ID NO: 4495 - protein, 7 aa, Artificial Sequence
  Description of Artificial Sequence: Synthetic peptide
GYTFTGD

SEQ ID NO: 4496 - protein, 6 aa, Artificial Sequence
  Description of Artificial Sequence: Synthetic peptide
NPNSGG

SEQ ID NO: 4497 - protein, 13 aa, Artificial Sequence
  Description of Artificial Sequence: Synthetic peptide
EGGVAPAAPDAFD

SEQ ID NO: 4498 - protein, 7 aa, Artificial Sequence
  Description of Artificial Sequence: Synthetic peptide
DSLRSYY

SEQ ID NO: 4499 - protein, 3 aa, Artificial Sequence
  Description of Artificial Sequence: Synthetic peptide
GKN

SEQ ID NO: 4500 - protein, 8 aa, Artificial Sequence
  Description of Artificial Sequence: Synthetic peptide
RDSSGNHR

SEQ ID NO: 4501 - protein, 10 aa, Artificial Sequence
  Description of Artificial Sequence: Synthetic peptide
GYTFTGDYIH

SEQ ID NO: 4502 - protein, 10 aa, Artificial Sequence
  Description of Artificial Sequence: Synthetic peptide
WINPNSGGTN

SEQ ID NO: 4503 - protein, 14 aa, Artificial Sequence
  Description of Artificial Sequence: Synthetic peptide
EGGVAPAAPDAFDI

SEQ ID NO: 4504 - protein, 11 aa, Artificial Sequence
  Description of Artificial Sequence: Synthetic peptide
QGDSLRSYYAR

SEQ ID NO: 4505 - protein, 7 aa, Artificial Sequence
  Description of Artificial Sequence: Synthetic peptide
GKNNRPS

SEQ ID NO: 4506 - protein, 11 aa, Artificial Sequence
  Description of Artificial Sequence: Synthetic peptide
NSRDSSGNHRV

SEQ ID NO: 4507 - protein, 6 aa, Artificial Sequence
  Description of Artificial Sequence: Synthetic peptide
TGDYIH

SEQ ID NO: 4508 - protein, 13 aa, Artificial Sequence
  Description of Artificial Sequence: Synthetic peptide
WMGWINPNSGGTN

SEQ ID NO: 4509 - protein, 15 aa, Artificial Sequence
  Description of Artificial Sequence: Synthetic peptide
AREGGVAPAAPDAFD

SEQ ID NO: 4510 - protein, 7 aa, Artificial Sequence
  Description of Artificial Sequence: Synthetic peptide
SYYARWY

SEQ ID NO: 4511 - protein, 10 aa, Artificial Sequence
  Description of Artificial Sequence: Synthetic peptide
VVIYGKNNRP

SEQ ID NO: 4512 - protein, 10 aa, Artificial Sequence
  Description of Artificial Sequence: Synthetic peptide
NSRDSSGNHR

SEQ ID NO: 4513 - protein, 8 aa, Artificial Sequence
  Description of Artificial Sequence: Synthetic peptide
GYTFTGDY

SEQ ID NO: 4514 - protein, 8 aa, Artificial Sequence
  Description of Artificial Sequence: Synthetic peptide
INPNSGGT

SEQ ID NO: 4515 - protein, 16 aa, Artificial Sequence
  Description of Artificial Sequence: Synthetic peptide
AREGGVAPAAPDAFDI

SEQ ID NO: 4516 - protein, 6 aa, Artificial Sequence
  Description of Artificial Sequence: Synthetic peptide
SLRSYY

SEQ ID NO: 4517 - protein, 3 aa, Artificial Sequence
  Description of Artificial Sequence: Synthetic peptide
GKN

SEQ ID NO: 4518 - protein, 11 aa, Artificial Sequence
  Description of Artificial Sequence: Synthetic peptide
NSRDSSGNHRV

SEQ ID NO: 4519 - protein, 123 aa, Artificial Sequence
  Description of Artificial Sequence: Synthetic polypeptide
EVQLVQSGPEVKKPGASVKVSCKASGYTFTGDYIHWVRQVPGQGLEWMGWINPNSGGTNYAQKFQGRVTMTRDTSISTAFMELSRLRSDDTAVYYCAREGGVAPAAPDAFDIWGQGTMVTVSS

SEQ ID NO: 4520 - protein, 108 aa, Artificial Sequence
  Description of Artificial Sequence: Synthetic polypeptide
SSELTQDPAVSVALGQTVRITCQGDSLRSYYARWYQQKPGQAPVVVIYGKNNRPSGIPDRFSGSSSGNTASLTITGAQAEDEADYYCNSRDSSGNHRVFGGGTKLTVL

SEQ ID NO: 4521 - protein, 453 aa, Artificial Sequence
  Description of Artificial Sequence: Synthetic polypeptide
EVQLVQSGPEVKKPGASVKVSCKASGYTFTGDYIHWVRQVPGQGLEWMGWINPNSGGTNYAQKFQGRVTMTRDTSISTAFMELSRLRSDDTAVYYCAREGGVAPAAPDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4522 - protein, 214 aa, Artificial Sequence
  Description of Artificial Sequence: Synthetic polypeptide
SSELTQDPAVSVALGQTVRITCQGDSLRSYYARWYQQKPGQAPVVVIYGKNNRPSGIPDRFSGSSSGNTASLTITGAQAEDEADYYCNSRDSSGNHRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4523 - protein, 5 aa, Artificial Sequence
  Description of Artificial Sequence: Synthetic peptide
NYYWS

SEQ ID NO: 4524 - protein, 16 aa, Artificial Sequence
  Description of Artificial Sequence: Synthetic peptide
RIYSSGITNYNPSLKS

SEQ ID NO: 4525 - protein, 10 aa, Artificial Sequence
  Description of Artificial Sequence: Synthetic peptide
IVGVKGAFAI

SEQ ID NO: 4526 - protein, 14 aa, Artificial Sequence
  Description of Artificial Sequence: Synthetic peptide
TGTSSDVGGYNYVS

SEQ ID NO: 4527 - protein, 7 aa, Artificial Sequence
  Description of Artificial Sequence: Synthetic peptide
EVSNRPS

SEQ ID NO: 4528 - protein, 9 aa, Artificial Sequence
  Description of Artificial Sequence: Synthetic peptide
SSYTSTSVV

SEQ ID NO: 4529 - protein, 7 aa, Artificial Sequence
  Description of Artificial Sequence: Synthetic peptide
GGSISNY

SEQ ID NO: 4530 - protein, 5 aa, Artificial Sequence
  Description of Artificial Sequence: Synthetic peptide
YSSGI

SEQ ID NO: 4531 - protein, 9 aa, Artificial Sequence
  Description of Artificial Sequence: Synthetic peptide
IVGVKGAFA

SEQ ID NO: 4532 - protein, 10 aa, Artificial Sequence
  Description of Artificial Sequence: Synthetic peptide
TSSDVGGYNY

SEQ ID NO: 4533 - protein, 3 aa, Artificial Sequence
  Description of Artificial Sequence: Synthetic peptide
EVS

SEQ ID NO: 4534 - protein, 6 aa, Artificial Sequence
  Description of Artificial Sequence: Synthetic peptide
YTSTSV

SEQ ID NO: 4535 - protein, 10 aa, Artificial Sequence
  Description of Artificial Sequence: Synthetic peptide
GGSISNYYWS

SEQ ID NO: 4536 - protein, 9 aa, Artificial Sequence
  Description of Artificial Sequence: Synthetic peptide
RIYSSGITN

SEQ ID NO: 4537 - protein, 10 aa, Artificial Sequence
  Description of Artificial Sequence: Synthetic peptide
IVGVKGAFAI

SEQ ID NO: 4538 - protein, 14 aa, Artificial Sequence
  Description of Artificial Sequence: Synthetic peptide
TGTSSDVGGYNYVS

SEQ ID NO: 4539 - protein, 7 aa, Artificial Sequence
  Description of Artificial Sequence: Synthetic peptide
EVSNRPS

SEQ ID NO: 4540 - protein, 9 aa, Artificial Sequence
  Description of Artificial Sequence: Synthetic peptide
SSYTSTSVV

SEQ ID NO: 4541 - protein, 6 aa, Artificial Sequence
  Description of Artificial Sequence: Synthetic peptide
SNYYWS

SEQ ID NO: 4542 - protein, 12 aa, Artificial Sequence
  Description of Artificial Sequence: Synthetic peptide
WIGRIYSSGITN

SEQ ID NO: 4543 - protein, 11 aa, Artificial Sequence
  Description of Artificial Sequence: Synthetic peptide
AGIVGVKGAFA

SEQ ID NO: 4544 - protein, 10 aa, Artificial Sequence
  Description of Artificial Sequence: Synthetic peptide
VGGYNYVSWY

SEQ ID NO: 4545 - protein, 10 aa, Artificial Sequence
  Description of Artificial Sequence: Synthetic peptide
LMIYEVSNRP

SEQ ID NO: 4546 - protein, 8 aa, Artificial Sequence
  Description of Artificial Sequence: Synthetic peptide
SSYTSTSV

SEQ ID NO: 4547 - protein, 8 aa, Artificial Sequence
  Description of Artificial Sequence: Synthetic peptide
GGSISNYY

SEQ ID NO: 4548 - protein, 7 aa, Artificial Sequence
  Description of Artificial Sequence: Synthetic peptide
IYSSGIT

SEQ ID NO: 4549 - protein, 12 aa, Artificial Sequence
  Description of Artificial Sequence: Synthetic peptide
AGIVGVKGAFAI

SEQ ID NO: 4550 - protein, 9 aa, Artificial Sequence
  Description of Artificial Sequence: Synthetic peptide
SSDVGGYNY

SEQ ID NO: 4551 - protein, 3 aa, Artificial Sequence
  Description of Artificial Sequence: Synthetic peptide
EVS

SEQ ID NO: 4552 - protein, 9 aa, Artificial Sequence
  Description of Artificial Sequence: Synthetic peptide
SSYTSTSVV

SEQ ID NO: 4553 - protein, 118 aa, Artificial Sequence; identical to SEQ ID NO: 3329
  Description of Artificial Sequence: Synthetic polypeptide

SEQ ID NO: 4554 - protein, 109 aa, Artificial Sequence; identical to SEQ ID NO: 3636
  Description of Artificial Sequence: Synthetic polypeptide

SEQ ID NO: 4555 - protein, 448 aa, Artificial Sequence; identical to SEQ ID NO: 3331
  Description of Artificial Sequence: Synthetic polypeptide

SEQ ID NO: 4556 - protein, 215 aa, Artificial Sequence; identical to SEQ ID NO: 3638
  Description of Artificial Sequence: Synthetic polypeptide

SEQ ID NO: 4557 - protein, 5 aa, Artificial Sequence
  Description of Artificial Sequence: Synthetic peptide
GYYIH

SEQ ID NO: 4558 - protein, 17 aa, Artificial Sequence
  Description of Artificial Sequence: Synthetic peptide
WINPNSGYTNSAQKFQG

SEQ ID NO: 4559 - protein, 7 aa, Artificial Sequence
  Description of Artificial Sequence: Synthetic peptide
EDDAFDI

SEQ ID NO: 4560 - protein, 11 aa, Artificial Sequence
  Description of Artificial Sequence: Synthetic peptide
QGDSLRSYYAR

SEQ ID NO: 4561 - protein, 7 aa, Artificial Sequence
  Description of Artificial Sequence: Synthetic peptide
GKNNRPS

SEQ ID NO: 4562 - protein, 11 aa, Artificial Sequence
  Description of Artificial Sequence: Synthetic peptide
NSRDNSGNHVV

SEQ ID NO: 4563 - protein, 7 aa, Artificial Sequence
  Description of Artificial Sequence: Synthetic peptide
GYTFTGY

SEQ ID NO: 4564 - protein, 6 aa, Artificial Sequence
  Description of Artificial Sequence: Synthetic peptide
NPNSGY

SEQ ID NO: 4565 - protein, 6 aa, Artificial Sequence
  Description of Artificial Sequence: Synthetic peptide
EDDAFD

SEQ ID NO: 4566 - protein, 7 aa, Artificial Sequence
  Description of Artificial Sequence: Synthetic peptide
DSLRSYY

SEQ ID NO: 4567 - protein, 3 aa, Artificial Sequence
  Description of Artificial Sequence: Synthetic peptide
GKN

SEQ ID NO: 4568 - protein, 8 aa, Artificial Sequence
  Description of Artificial Sequence: Synthetic peptide
RDNSGNHV

SEQ ID NO: 4569 - protein, 10 aa, Artificial Sequence
  Description of Artificial Sequence: Synthetic peptide
GYTFTGYYIH

SEQ ID NO: 4570 - protein, 10 aa, Artificial Sequence
  Description of Artificial Sequence: Synthetic peptide
WINPNSGYTN

SEQ ID NO: 4571 - protein, 7 aa, Artificial Sequence
  Description of Artificial Sequence: Synthetic peptide
EDDAFDI

SEQ ID NO: 4572 - protein, 11 aa, Artificial Sequence
  Description of Artificial Sequence: Synthetic peptide
QGDSLRSYYAR

SEQ ID NO: 4573 - protein, 7 aa, Artificial Sequence
  Description of Artificial Sequence: Synthetic peptide
GKNNRPS

SEQ ID NO: 4574 - protein, 11 aa, Artificial Sequence
  Description of Artificial Sequence: Synthetic peptide
NSRDNSGNHVV

SEQ ID NO: 4575 - protein, 6 aa, Artificial Sequence
  Description of Artificial Sequence: Synthetic peptide
TGYYIH

SEQ ID NO: 4576 - protein, 13 aa, Artificial Sequence
  Description of Artificial Sequence: Synthetic peptide
WMGWINPNSGYTN

SEQ ID NO: 4577 - protein, 8 aa, Artificial Sequence
  Description of Artificial Sequence: Synthetic peptide
AREDDAFD

SEQ ID NO: 4578 - protein, 7 aa, Artificial Sequence
  Description of Artificial Sequence: Synthetic peptide
SYYARWY

SEQ ID NO: 4579 - protein, 10 aa, Artificial Sequence
  Description of Artificial Sequence: Synthetic peptide
LVIYGKNNRP

SEQ ID NO: 4580 - protein, 10 aa, Artificial Sequence
  Description of Artificial Sequence: Synthetic peptide
NSRDNSGNHV

SEQ ID NO: 4581 - protein, 8 aa, Artificial Sequence
  Description of Artificial Sequence: Synthetic peptide
GYTFTGYY

SEQ ID NO: 4582 - protein, 8 aa, Artificial Sequence
  Description of Artificial Sequence: Synthetic peptide
INPNSGYT

SEQ ID NO: 4583 - protein, 9 aa, Artificial Sequence
  Description of Artificial Sequence: Synthetic peptide
AREDDAFDI

SEQ ID NO: 4584 - protein, 6 aa, Artificial Sequence
  Description of Artificial Sequence: Synthetic peptide
SLRSYY

SEQ ID NO: 4585 - protein, 3 aa, Artificial Sequence
  Description of Artificial Sequence: Synthetic peptide
GKN

SEQ ID NO: 4586 - protein, 11 aa, Artificial Sequence
  Description of Artificial Sequence: Synthetic peptide
NSRDNSGNHVV

SEQ ID NO: 4587 - protein, 116 aa, Artificial Sequence
  Description of Artificial Sequence: Synthetic polypeptide
QVQLVQSGAEVKRPGASAKVSCKTSGYTFTGYYIHWVRQAPGQGLEWMGWINPNSGYTNSAQKFQGRVSMTRDTSISTVYMELSRLRSDDTAVYYCAREDDAFDIWGQGTLVTVSS

SEQ ID NO: 4588 - protein, 108 aa, Artificial Sequence
  Description of Artificial Sequence: Synthetic polypeptide
SSELTQDPAVSVALGQTVRITCQGDSLRSYYARWYQQKPGQAPVLVIYGKNNRPSGIPDRFSGSSSGDTASLTITGALAEDEADYYCNSRDNSGNHVVFGGGTKVTVL

SEQ ID NO: 4589 - protein, 446 aa, Artificial Sequence
  Description of Artificial Sequence: Synthetic polypeptide
QVQLVQSGAEVKRPGASAKVSCKTSGYTFTGYYIHWVRQAPGQGLEWMGWINPNSGYTNSAQKFQGRVSMTRDTSISTVYMELSRLRSDDTAVYYCAREDDAFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4590 - protein, 214 aa, Artificial Sequence
  Description of Artificial Sequence: Synthetic polypeptide
SSELTQDPAVSVALGQTVRITCQGDSLRSYYARWYQQKPGQAPVLVIYGKNNRPSGIPDRFSGSSSGDTASLTITGALAEDEADYYCNSRDNSGNHVVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4591 - protein, 5 aa, Artificial Sequence
  Description of Artificial Sequence: Synthetic peptide
NYAIS

SEQ ID NO: 4592 - protein, 17 aa, Artificial Sequence
  Description of Artificial Sequence: Synthetic peptide
GIIPIFSAGTYAQRFQG

SEQ ID NO: 4593 - protein, 14 aa, Artificial Sequence
  Description of Artificial Sequence: Synthetic peptide
NSGTYYDYYYGMDV

SEQ ID NO: 4594 - protein, 16 aa, Artificial Sequence
  Description of Artificial Sequence: Synthetic peptide
RSSQSLVHSDGNTYLS

SEQ ID NO: 4595 - protein, 7 aa, Artificial Sequence
  Description of Artificial Sequence: Synthetic peptide
KIFNRLS

SEQ ID NO: 4596 - protein, 9 aa, Artificial Sequence
  Description of Artificial Sequence: Synthetic peptide
MQAKQFPLT

SEQ ID NO: 4597 - protein, 7 aa, Artificial Sequence
  Description of Artificial Sequence: Synthetic peptide
GGTFSNY

SEQ ID NO: 4598 - protein, 6 aa, Artificial Sequence
  Description of Artificial Sequence: Synthetic peptide
IPIFSA

SEQ ID NO: 4599 - protein, 13 aa, Artificial Sequence
  Description of Artificial Sequence: Synthetic peptide
NSGTYYDYYYGMD

SEQ ID NO: 4600 - protein, 12 aa, Artificial Sequence
  Description of Artificial Sequence: Synthetic peptide
SQSLVHSDGNTY

SEQ ID NO: 4601 - protein, 3 aa, Artificial Sequence
  Description of Artificial Sequence: Synthetic peptide
KIF

SEQ ID NO: 4602 - protein, 6 aa, Artificial Sequence
  Description of Artificial Sequence: Synthetic peptide
AKQFPL

SEQ ID NO: 4603 - protein, 10 aa, Artificial Sequence
  Description of Artificial Sequence: Synthetic peptide
GGTFSNYAIS

SEQ ID NO: 4604 - protein, 10 aa, Artificial Sequence
  Description of Artificial Sequence: Synthetic peptide
GIIPIFSAGT

SEQ ID NO: 4605 - protein, 14 aa, Artificial Sequence
  Description of Artificial Sequence: Synthetic peptide
NSGTYYDYYYGMDV

SEQ ID NO: 4606 - protein, 16 aa, Artificial Sequence
  Description of Artificial Sequence: Synthetic peptide
RSSQSLVHSDGNTYLS

SEQ ID NO: 4607 - protein, 7 aa, Artificial Sequence
  Description of Artificial Sequence: Synthetic peptide
KIFNRLS

SEQ ID NO: 4608 - protein, 9 aa, Artificial Sequence
  Description of Artificial Sequence: Synthetic peptide
MQAKQFPLT

SEQ ID NO: 4609 - protein, 6 aa, Artificial Sequence
  Description of Artificial Sequence: Synthetic peptide
SNYAIS

SEQ ID NO: 4610 - protein, 13 aa, Artificial Sequence
  Description of Artificial Sequence: Synthetic peptide
WMGGIIPIFSAGT

SEQ ID NO: 4611 - protein, 15 aa, Artificial Sequence
  Description of Artificial Sequence: Synthetic peptide
SSNSGTYYDYYYGMD

SEQ ID NO: 4612 - protein, 12 aa, Artificial Sequence
  Description of Artificial Sequence: Synthetic peptide
VHSDGNTYLSWL

SEQ ID NO: 4613 - protein, 10 aa, Artificial Sequence
  Description of Artificial Sequence: Synthetic peptide
LLIYKIFNRL

SEQ ID NO: 4614 - protein, 8 aa, Artificial Sequence
  Description of Artificial Sequence: Synthetic peptide
MQAKQFPL

SEQ ID NO: 4615 - protein, 8 aa, Artificial Sequence
  Description of Artificial Sequence: Synthetic peptide
GGTFSNYA

SEQ ID NO: 4616 - protein, 8 aa, Artificial Sequence
  Description of Artificial Sequence: Synthetic peptide
IIPIFSAG

SEQ ID NO: 4617 - protein, 16 aa, Artificial Sequence
  Description of Artificial Sequence: Synthetic peptide
SSNSGTYYDYYYGMDV

SEQ ID NO: 4618 - protein, 11 aa, Artificial Sequence
  Description of Artificial Sequence: Synthetic peptide
QSLVHSDGNTY

SEQ ID NO: 4619 - protein, 3 aa, Artificial Sequence
  Description of Artificial Sequence: Synthetic peptide
KIF

SEQ ID NO: 4620 - protein, 9 aa, Artificial Sequence
  Description of Artificial Sequence: Synthetic peptide
MQAKQFPLT

SEQ ID NO: 4621 - protein, 123 aa, Artificial Sequence
  Description of Artificial Sequence: Synthetic polypeptide
EVQLVQSGAEVKKPGSSVKVSCKASGGTFSNYAISWVRLAPGQGLEWMGGIIPIFSAGTYAQRFQGRVTITADKSTSTAYMELNSLRSEDTAVYYCSSNSGTYYDYYYGMDVWGQGTMVTVSS

SEQ ID NO: 4622 - protein, 112 aa, Artificial Sequence
  Description of Artificial Sequence: Synthetic polypeptide
DIVMTQSPLSSHVTLGQPASISCRSSQSLVHSDGNTYLSWLQQRPGQPPRLLIYKIFNRLSGVPDRFSGSGAGTDFTLKISRVEAEDVGVYYCMQAKQFPLTFGGGTKVEIK

SEQ ID NO: 4623 - protein, 453 aa, Artificial Sequence
  Description of Artificial Sequence: Synthetic polypeptide
EVQLVQSGAEVKKPGSSVKVSCKASGGTFSNYAISWVRLAPGQGLEWMGGIIPIFSAGTYAQRFQGRVTITADKSTSTAYMELNSLRSEDTAVYYCSSNSGTYYDYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4624 - protein, 219 aa, Artificial Sequence
  Description of Artificial Sequence: Synthetic polypeptide
DIVMTQSPLSSHVTLGQPASISCRSSQSLVHSDGNTYLSWLQQRPGQPPRLLIYKIFNRLSGVPDRFSGSGAGTDFTLKISRVEAEDVGVYYCMQAKQFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4625 - protein, 5 aa, Artificial Sequence
  Description of Artificial Sequence: Synthetic peptide
SYAIS

SEQ ID NO: 4626 - protein, 17 aa, Artificial Sequence
  Description of Artificial Sequence: Synthetic peptide
GIIPFFGTADYAQKFQG

SEQ ID NO: 4627 - protein, 13 aa, Artificial Sequence
  Description of Artificial Sequence: Synthetic peptide
ATVTTDYYYGMDV

SEQ ID NO: 4628 - protein, 16 aa, Artificial Sequence
  Description of Artificial Sequence: Synthetic peptide
RSSQSLVHSDGNTYLS

SEQ ID NO: 4629 - protein, 7 aa, Artificial Sequence
  Description of Artificial Sequence: Synthetic peptide
EISNRFT

SEQ ID NO: 4630 - protein, 9 aa, Artificial Sequence
  Description of Artificial Sequence: Synthetic peptide
MQARQFPLT

SEQ ID NO: 4631 - protein, 7 aa, Artificial Sequence
  Description of Artificial Sequence: Synthetic peptide
GGTFSSY

SEQ ID NO: 4632 - protein, 6 aa, Artificial Sequence
  Description of Artificial Sequence: Synthetic peptide
IPFFGT

SEQ ID NO: 4633 - protein, 12 aa, Artificial Sequence
  Description of Artificial Sequence: Synthetic peptide
ATVTTDYYYGMD

SEQ ID NO: 4634 - protein, 12 aa, Artificial Sequence
  Description of Artificial Sequence: Synthetic peptide
SQSLVHSDGNTY

SEQ ID NO: 4635 - protein, 3 aa, Artificial Sequence
  Description of Artificial Sequence: Synthetic peptide
EIS

SEQ ID NO: 4636 - protein, 6 aa, Artificial Sequence
  Description of Artificial Sequence: Synthetic peptide
ARQFPL

SEQ ID NO: 4637 - protein, 10 aa, Artificial Sequence
  Description of Artificial Sequence: Synthetic peptide
GGTFSSYAIS

SEQ ID NO: 4638 - protein, 10 aa, Artificial Sequence
  Description of Artificial Sequence: Synthetic peptide
GIIPFFGTAD

SEQ ID NO: 4639 - protein, 13 aa, Artificial Sequence
  Description of Artificial Sequence: Synthetic peptide
ATVTTDYYYGMDV

SEQ ID NO: 4640 - protein, 16 aa, Artificial Sequence
  Description of Artificial Sequence: Synthetic peptide
RSSQSLVHSDGNTYLS

SEQ ID NO: 4641 - protein, 7 aa, Artificial Sequence
  Description of Artificial Sequence: Synthetic peptide
EISNRFT

SEQ ID NO: 4642 - protein, 9 aa, Artificial Sequence
  Description of Artificial Sequence: Synthetic peptide
MQARQFPLT

SEQ ID NO: 4643 - protein, 6 aa, Artificial Sequence
  Description of Artificial Sequence: Synthetic peptide
SSYAIS

SEQ ID NO: 4644 - protein, 13 aa, Artificial Sequence
  Description of Artificial Sequence: Synthetic peptide
WMGGIIPFFGTAD

SEQ ID NO: 4645 - protein, 14 aa, Artificial Sequence
  Description of Artificial Sequence: Synthetic peptide
ATATVTTDYYYGMD

SEQ ID NO: 4646 - protein, 12 aa, Artificial Sequence
  Description of Artificial Sequence: Synthetic peptide
VHSDGNTYLSWL

SEQ ID NO: 4647 - protein, 10 aa, Artificial Sequence
  Description of Artificial Sequence: Synthetic peptide
LLIYEISNRF

SEQ ID NO: 4648 - protein, 8 aa, Artificial Sequence
  Description of Artificial Sequence: Synthetic peptide
MQARQFPL

SEQ ID NO: 4649 - protein, 8 aa, Artificial Sequence
  Description of Artificial Sequence: Synthetic peptide
GGTFSSYA

SEQ ID NO: 4650 - protein, 8 aa, Artificial Sequence
  Description of Artificial Sequence: Synthetic peptide
IIPFFGTA

SEQ ID NO: 4651 - protein, 15 aa, Artificial Sequence
  Description of Artificial Sequence: Synthetic peptide
ATATVTTDYYYGMDV

SEQ ID NO: 4652 - protein, 11 aa, Artificial Sequence
  Description of Artificial Sequence: Synthetic peptide
QSLVHSDGNTY

SEQ ID NO: 4653 - protein, 3 aa, Artificial Sequence
  Description of Artificial Sequence: Synthetic peptide
EIS

SEQ ID NO: 4654 - protein, 9 aa, Artificial Sequence
  Description of Artificial Sequence: Synthetic peptide
MQARQFPLT

SEQ ID NO: 4655 - protein, 122 aa, Artificial Sequence
  Description of Artificial Sequence: Synthetic polypeptide
EVQLVESGAEVMKPGSSVKVSCKASGGTFSSYAISWVRQAPEQGLEWMGGIIPFFGTADYAQKFQGRVTITADKSTNTAYMELTSLRSEDTAVYYCATATVTTDYYYGMDVWGQGTMVTVSS

SEQ ID NO: 4656 - protein, 112 aa, Artificial Sequence
  Description of Artificial Sequence: Synthetic polypeptide
EIVMTQSPLFSPVTLGQPASISCRSSQSLVHSDGNTYLSWLQQRPGQPPRLLIYEISNRFTGVPDRFSGSGAGTDFTLKISRVEAEDVGVYYCMQARQFPLTFGGGTKVEIK

SEQ ID NO: 4657 - protein, 452 aa, Artificial Sequence
  Description of Artificial Sequence: Synthetic polypeptide
EVQLVESGAEVMKPGSSVKVSCKASGGTFSSYAISWVRQAPEQGLEWMGGIIPFFGTADYAQKFQGRVTITADKSTNTAYMELTSLRSEDTAVYYCATATVTTDYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4658 - protein, 219 aa, Artificial Sequence
  Description of Artificial Sequence: Synthetic polypeptide
EIVMTQSPLFSPVTLGQPASISCRSSQSLVHSDGNTYLSWLQQRPGQPPRLLIYEISNRFTGVPDRFSGSGAGTDFTLKISRVEAEDVGVYYCMQARQFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4659 - protein, 493 aa, Artificial Sequence
  Description of Artificial Sequence: Synthetic polypeptide
MAWVWTLLFLMAAAQSIQAAGHLEQPQISSTKTLSKTARLECVVSGITISATSVYWYRERPGEVIQFLVSISYDGTVRKESGIPSGKFEVDRIPETSTSTLTIHNVEKQDIATYYCALWEAQQELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 4660 - protein, 480 aa, Artificial Sequence
  Description of Artificial Sequence: Synthetic polypeptide
MAWVWTLLFLMAAAQSIQAAIELVPEHQTVPVSIGVPATLRCSMKGEAIGNYYINWYRKTQGNTMTFIYREKDIYGPGFKDNFQGDIDIAKNLAVLKILAPSERDEGSYYCACDTLGMGGEYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

What is claimed:

1. An antibody that binds a Vδ2 (TRDV2) polypeptide, the antibody comprising:
(1) (i) a VH comprising a VH CDR1, a VH CDR2, and a VH CDR3 having an amino acid sequence of a VH CDR1, a VH CDR2, and a VH CDR3, respectively, of a VH having the amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of a VL having the amino acid sequence of SEQ ID NO:2038;
(2) (i) a VH comprising a VH CDR1, a VH CDR2, and a VH CDR3 having an amino acid sequence of a VH CDR1, a VH CDR2, and a VH CDR3, respectively, of a VH having the amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of a VL having the amino acid sequence of SEQ ID NO:2072;
(3) (i) a VH comprising a VH CDR1, a VH CDR2, and a VH CDR3 having an amino acid sequence of a VH CDR1, a VH CDR2, and a VH CDR3, respectively, of a VH having the amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of a VL having the amino acid sequence of SEQ ID NO:2106;
(4) (i) a VH comprising a VH CDR1, a VH CDR2, and a VH CDR3 having an amino acid sequence of a VH CDR1, a VH CDR2, and a VH CDR3, respectively, of a VH having the amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of a VL having the amino acid sequence of SEQ ID NO:2140;
(5) (i) a VH comprising a VH CDR1, a VH CDR2, and a VH CDR3 having an amino acid sequence of a VH CDR1, a VH CDR2, and a VH CDR3, respectively, of a VH having the amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of a VL having the amino acid sequence of SEQ ID NO:2174;

(6) (i) a VH comprising a VH CDR1, a VH CDR2, and a VH CDR3 having an amino acid sequence of a VH CDR1, a VH CDR2, and a VH CDR3, respectively, of a VH having the amino acid sequence of SEQ ID NO:2207; and (ii) a VL comprising a VL CDR1, a VL CDR2, and a VL CDR3 having an amino acid sequence of a VL CDR1, a VL CDR2, and a VL CDR3, respectively, of a VL having the amino acid sequence of SEQ ID NO:2208;

(7) (i) a VH comprising a VH CDR1, a VH CDR2, and a VH CDR3 having an amino acid sequence of a VH CDR1, a VH CDR2, and a VH CDR3, respectively, of a VH having the amino acid sequence of SEQ ID NO:2241; and (ii) a VL comprising a VL CDR1, a VL CDR2, and a VL CDR3 having an amino acid sequence of a VL CDR1, a VL CDR2, and a VL CDR3, respectively, of a VL having the amino acid sequence of SEQ ID NO:2242;

(8) (i) a VH comprising a VH CDR1, a VH CDR2, and a VH CDR3 having an amino acid sequence of a VH CDR1, a VH CDR2, and a VH CDR3, respectively, of a VH having the amino acid sequence of SEQ ID NO:2275; and (ii) a VL comprising a VL CDR1, a VL CDR2, and a VL CDR3 having an amino acid sequence of a VL CDR1, a VL CDR2, and a VL CDR3, respectively, of a VL having the amino acid sequence of SEQ ID NO:2276;

(9) (i) a VH comprising a VH CDR1, a VH CDR2, and a VH CDR3 having an amino acid sequence of a VH CDR1, a VH CDR2, and a VH CDR3, respectively, of a VH having the amino acid sequence of SEQ ID NO:2309; and (ii) a VL comprising a VL CDR1, a VL CDR2, and a VL CDR3 having an amino acid sequence of a VL CDR1, a VL CDR2, and a VL CDR3, respectively, of a VL having the amino acid sequence of SEQ ID NO:2310;

(10) (i) a VH comprising a VH CDR1, a VH CDR2, and a VH CDR3 having an amino acid sequence of a VH CDR1, a VH CDR2, and a VH CDR3, respectively, of a VH having the amino acid sequence of SEQ ID NO:2785; and (ii) a VL comprising a VL CDR1, a VL CDR2, and a VL CDR3 having an amino acid sequence of a VL CDR1, a VL CDR2, and a VL CDR3, respectively, of a VL having the amino acid sequence of SEQ ID NO:2786;

optionally wherein
(a) the antibody binds a TRDV2 antigen or a TRDV2 epitope;
(b) the antibody specifically binds to TRDV2;
(c) the VH CDR1, VH CDR2, VH CDR3, VL CDR1, VL CDR2 and VL CDR3 form a binding site for an antigen or an epitope of the TRDV2; or
(d) the TRDV2 is present on the surface of a T cell.

2. The antibody of claim 1, wherein the VH CDR1, VH CDR2, VH CDR3, VL CDR1, VL CDR2, and VL CDR3 amino acid sequences are according to
(a) the Kabat numbering system,
(b) the Chothia numbering system,
(c) the AbM numbering system,
(d) the Contact numbering system or
(e) the IMGT numbering system.

3. The antibody of claim 1, wherein the antibody:
(a) is a humanized antibody;
(b) is an IgG antibody; wherein optionally the IgG antibody is an IgG1, IgG2, IgG3, or IgG4 antibody;
(c) comprises a kappa light chain or a lambda light chain; or
(d) is a monoclonal antibody.

4. The antibody of claim 1, wherein the antibody is multivalent; wherein optionally
(a) the antibody is capable of binding at least three antigens;
(b) the antibody is capable of binding at least four antigens; or
(c) the antibody is capable of binding at least five antigens.

5. The antibody of claim 1, wherein the antibody is a multispecific antibody, wherein optionally the multispecific antibody is a bispecific antibody, a trispecific antibody, or a quadraspecific antibody.

6. The multispecific antibody of claim 5, wherein
the multispecific antibody is a multispecific TRDV2 antibody, comprising a first binding domain that binds TRDV2, and a second binding domain that binds to a second target; wherein the first binding domain that binds to TRDV2 comprises:

(1) (i) a VH comprising a VH CDR1, a VH CDR2, and a VH CDR3 having an amino acid sequence of a VH CDR1, a VH CDR2, and a VH CDR3, respectively, of a VH having the amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of a VL having the amino acid sequence of SEQ ID NO:2038;

(2) (i) a VH comprising a VH CDR1, a VH CDR2, and a VH CDR3 having an amino acid sequence of a VH CDR1, a VH CDR2, and a VH CDR3, respectively, of a VH having the amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of a VL having the amino acid sequence of SEQ ID NO:2072;

(3) (i) a VH comprising a VH CDR1, a VH CDR2, and a VH CDR3 having an amino acid sequence of a VH CDR1, a VH CDR2, and a VH CDR3, respectively, of a VH having amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of a VL having amino acid sequence of SEQ ID NO:2106;

(4) (i) a VH comprising a VH CDR1, a VH CDR2, and a VH CDR3 having an amino acid sequence of a VH CDR1, a VH CDR2, and a VH CDR3, respectively, of a VH having amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of a VL having amino acid sequence of SEQ ID NO:2140;

(5) (i) a VH comprising a VH CDR1, a VH CDR2, and a VH CDR3 having an amino acid sequence of a VH CDR1, a VH CDR2, and a VH CDR3, respectively, of a VH having amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of a VL having the amino acid sequence of SEQ ID NO:2174;

(6) (i) a VH comprising a VH CDR1, a VH CDR2, and a VH CDR3 having an amino acid sequence of a VH CDR1, a VH CDR2, and a VH CDR3, respectively, of a VH having amino acid sequence of SEQ ID NO:2207; and (ii) a VL comprising a VL CDR1, a VL CDR2, and a VL CDR3 having an amino acid sequence of a VL CDR1, a VL CDR2, and a VL CDR3, respectively, of a VL having amino acid sequence of SEQ ID NO:2208;

(7) (i) a VH comprising a VH CDR1, a VH CDR2, and a VH CDR3 having an amino acid sequence of a VH CDR1, a VH CDR2, and a VH CDR3, respectively, of a VH having amino acid sequence of SEQ ID NO:2241; and (ii) a VL comprising a VL CDR1, a VL CDR2, and a VL CDR3 having an amino acid sequence of a VL CDR1, a VL CDR2, and a VL CDR3, respectively, of a VL having amino acid sequence of SEQ ID NO:2242;

(8) (i) a VH comprising a VH CDR1, a VH CDR2, and a VH CDR3 having an amino acid sequence of a VH CDR1, a VH CDR2, and a VH CDR3, respectively, of a VH having amino acid sequence of SEQ ID NO:2275; and (ii) a VL comprising a VL CDR1, a VL CDR2, and a VL CDR3 having an amino acid sequence of a VL CDR1, a VL CDR2, and a VL CDR3, respectively, of a VL having amino acid sequence of SEQ ID NO:2276;

(9) (i) a VH comprising a VH CDR1, a VH CDR2, and a VH CDR3 having an amino acid sequence of a VH CDR1, a VH CDR2, and a VH CDR3, respectively, of a VH having amino acid sequence of SEQ ID NO:2309; and (ii) a VL comprising a VL CDR1, a VL CDR2, and a VL CDR3 having an amino acid sequence of a VL CDR1, a VL CDR2, and a VL CDR3, respectively, of a VL having the amino acid sequence of SEQ ID NO:2310;

(10) (i) a VH comprising a VH CDR1, a VH CDR2, and a VH CDR3 having an amino acid sequence of a VH CDR1, a VH CDR2, and a VH CDR3, respectively, of a VH having the amino acid sequence of SEQ ID NO:2785; and (ii) a VL comprising a VL CDR1, a VL CDR2, and a VL CDR3 having an amino acid sequence of a VL CDR1, a VL CDR2, and a VL CDR3, respectively, of a VL having amino acid sequence of SEQ ID NO:2786.

7. A nucleic acid sequence encoding the antibody of claim 1.

8. A vector comprising the nucleic acid sequence of claim 7.

9. A host cell comprising the vector of claim 8.

10. A kit comprising the vector of claim 8 and packaging for the same.

11. A kit comprising the antibody of claim 1 and packaging for the same.

12. A pharmaceutical composition comprising the antibody of claim 1, and a pharmaceutically acceptable carrier.

13. A method of producing the pharmaceutical composition of claim 12, comprising combining the antibody with a pharmaceutically acceptable carrier to obtain the pharmaceutical composition.

* * * * *